United States Patent 10,987,387 (COMPOSITIONS COMPRISING BACTERIAL STRAIN) - sequence listing, part 2

SEQ ID NO: 2 - DNA, 3458289 bp, Enterococcus gallinarum (residues 1,729,146-3,458,289 of 3,458,289)
  modified_base (1)..(24): a, c, t, or g
  modified_base (142973)..(142981): a, c, t, or g
  modified_base (220260)..(220262): a, c, t, or g
  modified_base (267996)..(268005): a, c, t, or g
  modified_base (559463)..(559470): a, c, t, or g
  modified_base (736143)..(736143): a, c, t, or g
  modified_base (909086)..(909089): a, c, t, or g
  modified_base (1118319)..(1118329): a, c, t, or g
  modified_base (1285898)..(1285913): a, c, t, or g
  modified_base (1570949)..(1570949): a, c, t, or g
  modified_base (1664650)..(1664661): a, c, t, or g
  modified_base (1665322)..(1665343): a, c, t, or g
  modified_base (2316792)..(2316831): a, c, t, or g
  modified_base (2379761)..(2379763): a, c, t, or g
  modified_base (2504871)..(2504882): a, c, t, or g
  modified_base (2675546)..(2675549): a, c, t, or g
  modified_base (2788147)..(2788175): a, c, t, or g
  modified_base (2856264)..(2856356): a, c, t, or g
  modified_base (2871838)..(2871930): a, c, t, or g
  modified_base (2944459)..(2944491): a, c, t, or g
  modified_base (3028740)..(3028743): a, c, t, or g
  modified_base (3069181)..(3069182): a, c, t, or g
  modified_base (3109254)..(3109260): a, c, t, or g
  modified_base (3110866)..(3110933): a, c, t, or g
  modified_base (3141279)..(3141280): a, c, t, or g
  modified_base (3142219)..(3142285): a, c, t, or g
  modified_base (3146907)..(3146992): a, c, t, or g
  modified_base (3147524)..(3147557): a, c, t, or g
  modified_base (3148076)..(3148094): a, c, t, or g
  modified_base (3149544)..(3149723): a, c, t, or g
  modified_base (3151476)..(3151500): a, c, t, or g
  modified_base (3165480)..(3165495): a, c, t, or g
  modified_base (3165969)..(3166019): a, c, t, or g
  modified_base (3167873)..(3168031): a, c, t, or g
  modified_base (3168407)..(3168411): a, c, t, or g
  modified_base (3169298)..(3169370): a, c, t, or g
  modified_base (3170441)..(3170471): a, c, t, or g
  modified_base (3170806)..(3170817): a, c, t, or g
  modified_base (3171306)..(3171336): a, c, t, or g
  modified_base (3171735)..(3171828): a, c, t, or g
  modified_base (3172757)..(3172899): a, c, t, or g
  modified_base (3173562)..(3173592): a, c, t, or g
  modified_base (3173984)..(3174256): a, c, t, or g
  modified_base (3174579)..(3175462): a, c, t, or g
  modified_base (3175674)..(3176023): a, c, t, or g
  modified_base (3176308)..(3177510): a, c, t, or g
  modified_base (3177722)..(3179914): a, c, t, or g
  modified_base (3180215)..(3180319): a, c, t, or g
  modified_base (3180382)..(3180974): a, c, t, or g
  modified_base (3181034)..(3181079): a, c, t, or g
  modified_base (3181102)..(3181320): a, c, t, or g
  modified_base (3181851)..(3184112): a, c, t, or g
  modified_base (3184433)..(3184625): a, c, t, or g
  modified_base (3184972)..(3185410): a, c, t, or g
  modified_base (3185706)..(3185820): a, c, t, or g
  modified_base (3186134)..(3187333): a, c, t, or g
  modified_base (3187502)..(3188663): a, c, t, or g
  modified_base (3188835)..(3193388): a, c, t, or g
  modified_base (3193633)..(3196510): a, c, t, or g
  modified_base (3196609)..(3197829): a, c, t, or g
  modified_base (3198039)..(3198614): a, c, t, or g
  modified_base (3198832)..(3199931): a, c, t, or g
  modified_base (3200254)..(3200566): a, c, t, or g
  modified_base (3200847)..(3203183): a, c, t, or g
  modified_base (3203375)..(3207398): a, c, t, or g
  modified_base (3207438)..(3207528): a, c, t, or g
  modified_base (3207706)..(3211833): a, c, t, or g
  modified_base (3211969)..(3212092): a, c, t, or g
  modified_base (3212284)..(3212582): a, c, t, or g
  modified_base (3212734)..(3212773): a, c, t, or g
  modified_base (3213018)..(3214053): a, c, t, or g
  modified_base (3214222)..(3214271): a, c, t, or g
  modified_base (3214541)..(3214960): a, c, t, or g
  modified_base (3215267)..(3215472): a, c, t, or g
  modified_base (3215726)..(3216587): a, c, t, or g
  modified_base (3216785)..(3218296): a, c, t, or g
  modified_base (3218530)..(3218760): a, c, t, or g
  modified_base (3219012)..(3219795): a, c, t, or g
  modified_base (3220050)..(3221090): a, c, t, or g
  modified_base (3221322)..(3223894): a, c, t, or g
  modified_base (3224161)..(3230520): a, c, t, or g
  modified_base (3230813)..(3232601): a, c, t, or g
  modified_base (3232909)..(3233419): a, c, t, or g
  modified_base (3233611)..(3234786): a, c, t, or g
  modified_base (3235088)..(3235673): a, c, t, or g
  modified_base (3235824)..(3237674): a, c, t, or g
  modified_base (3237831)..(3241512): a, c, t, or g
  modified_base (3241699)..(3242995): a, c, t, or g
  modified_base (3243144)..(3243189): a, c, t, or g
  modified_base (3243397)..(3247317): a, c, t, or g
  modified_base (3247453)..(3248161): a, c, t, or g
  modified_base (3248328)..(3251400): a, c, t, or g
  modified_base (3251414)..(3251420): a, c, t, or g
  modified_base (3251594)..(3256219): a, c, t, or g
  modified_base (3256392)..(3257317): a, c, t, or g
  modified_base (3257631)..(3258550): a, c, t, or g
  modified_base (3258838)..(3259781): a, c, t, or g
  modified_base (3260096)..(3260313): a, c, t, or g
  modified_base (3260505)..(3261570): a, c, t, or g
  modified_base (3261798)..(3262070): a, c, t, or g
  modified_base (3262304)..(3262532): a, c, t, or g
  modified_base (3262780)..(3263122): a, c, t, or g
  modified_base (3263271)..(3264867): a, c, t, or g
  modified_base (3265141)..(3266308): a, c, t, or g
  modified_base (3266506)..(3267465): a, c, t, or g
  modified_base (3267766)..(3268320): a, c, t, or g
  modified_base (3268580)..(3270833): a, c, t, or g
  modified_base (3271089)..(3273205): a, c, t, or g
  modified_base (3273437)..(3277430): a, c, t, or g
  modified_base (3277641)..(3277821): a, c, t, or g
  modified_base (3278096)..(3280160): a, c, t, or g
  modified_base (3280449)..(3280684): a, c, t, or g
  modified_base (3280921)..(3280931): a, c, t, or g
  modified_base (3281150)..(3284451): a, c, t, or g
  modified_base (3284671)..(3285463): a, c, t, or g
  modified_base (3285737)..(3286015): a, c, t, or g
  modified_base (3286327)..(3286714): a, c, t, or g
  modified_base (3286923)..(3288102): a, c, t, or g
  modified_base (3288392)..(3290105): a, c, t, or g
  modified_base (3290286)..(3290644): a, c, t, or g
  modified_base (3290841)..(3292305): a, c, t, or g
  modified_base (3292502)..(3293508): a, c, t, or g
  modified_base (3293712)..(3294159): a, c, t, or g
  modified_base (3294253)..(3295678): a, c, t, or g
  modified_base (3295897)..(3295922): a, c, t, or g
  modified_base (3296138)..(3296499): a, c, t, or g
  modified_base (3296680)..(3298717): a, c, t, or g
  modified_base (3298881)..(3300180): a, c, t, or g
  modified_base (3300342)..(3301907): a, c, t, or g
  modified_base (3302209)..(3304136): a, c, t, or g
  modified_base (3304367)..(3307047): a, c, t, or g
  modified_base (3307245)..(3307258): a, c, t, or g
  modified_base (3307425)..(3307778): a, c, t, or g
  modified_base (3307974)..(3307977): a, c, t, or g
  modified_base (3308276)..(3309778): a, c, t, or g
  modified_base (3310075)..(3311599): a, c, t, or g
  modified_base (3311827)..(3312275): a, c, t, or g
  modified_base (3312494)..(3312796): a, c, t, or g
  modified_base (3313086)..(3313297): a, c, t, or g
  modified_base (3313346)..(3313615): a, c, t, or g
  modified_base (3313901)..(3314475): a, c, t, or g
  modified_base (3314631)..(3315786): a, c, t, or g
  modified_base (3316056)..(3316352): a, c, t, or g
  modified_base (3316633)..(3319175): a, c, t, or g
  modified_base (3319405)..(3320577): a, c, t, or g
  modified_base (3320866)..(3321091): a, c, t, or g
  modified_base (3321094)..(3321107): a, c, t, or g
  modified_base (3321376)..(3321821): a, c, t, or g
  modified_base (3322149)..(3322640): a, c, t, or g
  modified_base (3322901)..(3327311): a, c, t, or g
  modified_base (3327610)..(3329075): a, c, t, or g
  modified_base (3329456)..(3329938): a, c, t, or g
  modified_base (3330094)..(3332344): a, c, t, or g
  modified_base (3332539)..(3336139): a, c, t, or g
  modified_base (3336392)..(3337535): a, c, t, or g
  modified_base (3337717)..(3340103): a, c, t, or g
  modified_base (3340279)..(3341706): a, c, t, or g
  modified_base (3341972)..(3345145): a, c, t, or g
  modified_base (3345491)..(3345497): a, c, t, or g
  modified_base (3345783)..(3346604): a, c, t, or g
  modified_base (3346766)..(3347029): a, c, t, or g
  modified_base (3347288)..(3347503): a, c, t, or g
  modified_base (3347767)..(3348712): a, c, t, or g
  modified_base (3348842)..(3348886): a, c, t, or g
  modified_base (3349152)..(3351333): a, c, t, or g
  modified_base (3351537)..(3352255): a, c, t, or g
  modified_base (3352539)..(3355043): a, c, t, or g
  modified_base (3355309)..(3355530): a, c, t, or g
  modified_base (3355812)..(3356342): a, c, t, or g
  modified_base (3356563)..(3356592): a, c, t, or g
  modified_base (3356602)..(3357608): a, c, t, or g
  modified_base (3357788)..(3361443): a, c, t, or g
  modified_base (3361752)..(3365828): a, c, t, or g
  modified_base (3366131)..(3368322): a, c, t, or g
  modified_base (3368622)..(3369964): a, c, t, or g
  modified_base (3370252)..(3370817): a, c, t, or g
  modified_base (3371017)..(3371807): a, c, t, or g
  modified_base (3371947)..(3373566): a, c, t, or g
  modified_base (3373755)..(3375790): a, c, t, or g
  modified_base (3375983)..(3377395): a, c, t, or g
  modified_base (3377612)..(3377727): a, c, t, or g
  modified_base (3378001)..(3380329): a, c, t, or g
  modified_base (3380543)..(3382566): a, c, t, or g
  modified_base (3382891)..(3383786): a, c, t, or g
  modified_base (3384044)..(3384186): a, c, t, or g
  modified_base (3384475)..(3385740): a, c, t, or g
  modified_base (3385986)..(3386209): a, c, t, or g
  modified_base (3386474)..(3387189): a, c, t, or g
  modified_base (3387478)..(3388898): a, c, t, or g
  modified_base (3389065)..(3390386): a, c, t, or g
  modified_base (3390632)..(3391013): a, c, t, or g
  modified_base (3391230)..(3393880): a, c, t, or g
  modified_base (3394021)..(3399154): a, c, t, or g
  modified_base (3399306)..(3399521): a, c, t, or g
  modified_base (3399762)..(3402015): a, c, t, or g
  modified_base (3402285)..(3402297): a, c, t, or g
  modified_base (3402597)..(3406159): a, c, t, or g
  modified_base (3406365)..(3409023): a, c, t, or g
  modified_base (3409260)..(3410778): a, c, t, or g
  modified_base (3410976)..(3411201): a, c, t, or g
  modified_base (3411390)..(3411805): a, c, t, or g
  modified_base (3412045)..(3412055): a, c, t, or g
  modified_base (3412059)..(3412294): a, c, t, or g
  modified_base (3412544)..(3412784): a, c, t, or g
  modified_base (3413085)..(3415435): a, c, t, or g
  modified_base (3415699)..(3420047): a, c, t, or g
  modified_base (3420284)..(3422454): a, c, t, or g
  modified_base (3422651)..(3423711): a, c, t, or g
  modified_base (3423850)..(3424557): a, c, t, or g
  modified_base (3424758)..(3425080): a, c, t, or g
  modified_base (3425399)..(3426457): a, c, t, or g
  modified_base (3426755)..(3427023): a, c, t, or g
  modified_base (3427246)..(3428189): a, c, t, or g
  modified_base (3428437)..(3431547): a, c, t, or g
  modified_base (3431827)..(3432298): a, c, t, or g
  modified_base (3432559)..(3432692): a, c, t, or g
  modified_base (3432878)..(3437815): a, c, t, or g
  modified_base (3438032)..(3441139): a, c, t, or g
  modified_base (3441381)..(3441646): a, c, t, or g
  modified_base (3441833)..(3446421): a, c, t, or g
  modified_base (3446678)..(3449095): a, c, t, or g
  modified_base (3449332)..(3450918): a, c, t, or g
  modified_base (3451084)..(3458289): a, c, t, or g
catcatttcgcgagacttggacgactggatgatccatccgttgctcaatcgatgagtccggaccttcaggatgtcgccagtctgctctcgcaaccgcataccaccaactcatattggggatcagttggctcctctgtttcgtcttttcggaaagaaaataatgaaagacaaacgaccagccaaactgttctgcttccgtcacatagcctgttgccgcaataaatgcttcaaacatctgattggtaacagtcgtttcatcgatttcaaaagaggccatctcaacttggatcttgggaccttcttggtcctcttcaaagccagcttttgtatccgtgccaattcgatacgttccagcaggaatcttgatcatcccatctgccttctttctataataattgatagccgttataaagattgatggttagcaccaagaggatgactgtctggaagaccagcgtcactttttgtggtgagaggacagtgctgacttttgcccctaacaaaccgccaacaatcgcggctggaatcacaaaccacaaaatctttaagtcatagaggccaaatccagtggtcccagcaatcgtcacgattttcgccaattgagagaaaaaaatcgtacaaatcgaatagactgtcgcttctttgattggcaaagcaaacatcagcatcagcaaagaaacattgatcggtccgccgccgattcctagaagactggctagaaaaccaaggactaaaccacagaagcaataccagaagttatttttcagttggaatccgggccagtcatatttggtataaaagaaagcaaacaacaaggtcacgacggtcaaaaagatctgcaccatctgtacatggtcttcattctggaaaaacagcaacagctgatcaaaagcgacattgcccaagacaccgcctaagatggcgcctcctgaaacccaaaggacgatttgccaattgatcttatgtccgctagccaactgtcttgcggtagaaaccagcgacatagtaaagactgctacggcagaataaaacgagatggccgcaacagaatgggcgccgataaaatcaaaaatgggtttgatcagaacgcccccccccatgcctgaaacggcaccaaccgtattcgccaacacgatcactataaaataaatgaacccaatcacacacttcccccctgtaacaaacctaaaatccgattgatctgcggcacaaattcctgcaagagttgctgataaccgcaatagtccccatccacatagatggcatctttcattcgtttgcagccgccacgacacattttttgaaacgggcaactcagacatttctttggcatttcgggccgttgacacacaaacgtttttgcaatgtcctgttcaaataactgacgcaaggtctgttcttgaatataccccattcgatagtcatctaacacatagaaatcacaaggataaacactgccatctgcttcaatgacatattgcacttgacagtttcctaagatcccgcaggcggtgaattgttgcttgaccaataaattcaaaagatcatcaaaaagcttgatactcacataatgcccctccgctaattcttgcagccataactgcaaaagctggtggtaaaatcccgcaaaacgttttggtgtgagggcatagctatttctttctttcgcatctaaatcatctaaacaaggaataaactggacaaaatcgattttttgttcttttagaaagcgaaagactttcttagcctctttagccaatggattggtcaggacacaaagcacattgtagccaatctcaaagtggtcaaacagctgctttgtttgcagcactcgctgaaaagttcctcttcctttcggatcgacccgatgcaaatcatggtagagcggatggccatcgatcgagagaccgacccaaaaatcatgttctttcaaaaaagcacaccatttttcattgatcatggtcccgttcgtttgaatcgcataatggacctgtacctgcttttgctgttgatccactagttgggtcacttttcgaaaataattgaggcccgccatcgttggctctccaccttgaaacgctaatgtcaattgatcaccgtcttctaagtctgcataaatattttcgatcattttatctgttacttcttctttcattttgccaaacgagcggacttcccgcaaggaactgacattggcataaaagcagtagctgcagcgaagattgcagagggaagatgcgggtttgatcaatactgaaatatgtttcatggtagaagcctcgattctaaataactttttgaagttgctaatttatttaatttcttaatcccaaacgaatatattcactttctggcacttcaattcgatccatgatttttattaatttctggatcatcctttcttcaacgtcaggattatccagtggagtcaactgttgcggatcctcctccaagtcaaatagcaaatggccaactgaataagaatcaatgtatgtggagacttcaatttctgtataaggatactgatttgtgaagcgatttccctttctttgcttcatggtatctaatgcttccttattgatgaacccccttaacatcgcgtaattcaatgtttggatagtgattgggccgttggaaggatcaacagacgcacgcatatacacgtacttcccatcataaatattgacatgaccgccatttgttccaaaaatgatttcatcatgtaaaacagtctccttagactttagagctggcaataatgatttaccatccatatccaattcattcgcaataccaaaataatctaataaagttgcaggaatatcgatcgtttggcttaaaacagaagtatgggtatccacttcagcatttgggtaactgataaaaaatggcaaatggataatttcttcatacataggagcaacattctttcctaaccaatcatgctcaccaagaagaaaaccatgatccgtattaataatcaccaacgtatcctgccacatttgattcgtctctagaaaatcaatgacttttccgagatgatggtcacacattgctatcaatgcagcatattcgttttgtaattcaattaaatcatcggaagaaatgtcatctgtaacccgaccatactttggccaaaaataaggtgactcatttggacagtcctcataaagtttacgatatttttctggaacaaaaaagggttcatgagggtcaaagcattctatttgcaaaaaccaattatcttcttttttatattcttccaagaaatcaagtccagcttgaattgtttgaacactcgacatctcattttcatcaacttgtcttgtgcggttcgcaaaatgctgttcaactgaaatgccttgcttattcaaaggatttatttctgcatggccttcagcaaatttcctaggtacccagcgatcaccttcctgcccgcgaaacccctcccaagtagaatagcgattatgataggttgcccctccatcctcaaaatagtgagaatggtcggtcactaggtgacagtagatgccattttgttgtagcacatcaaaaatggaatgatcaaaaggctccaattgcccccacatgcgatgcataaagttatatcttcctgtatgaagttcacgacgtgctggcatacaaggcatacttcccccataaaaattatcgaaagtaaccgttttttcccttaagcgatcgaaatttggtgtttggatccaatcatttccataatttgacagaaaatcttttgacaacgtatcaaacattagcatgatagcgcgcatattttcccttcccttctttactatcgtatcatatagaacacaacttaatgaatcacttgaatgacttcattaacaatatctgggataacatccaaataagtatcagtatttgttacaacaaccggtgtgatgatcgagtagcctttggattgaattttttctttatcaaatcgaatcaacagctcgcctttccttacttgctgtccttgttttacgtaggaagtaaagaaatcgccttttaagttaacagtatccattccgacatgaatcaacaattcaatgccattcgtagattttaaaccgatcgcatgattcgttgggaacaatgtttctacagtagcatcgaatggcgcatagatctctccattgcttggaacaatcgctacaccttttcctaataacccagaagaaaaagcttcatcttcaacatcagccaatgtcagtaaatctcctttgataggcatctcaatctttgtttccgtcattaaataattatctattgctatctcttgctcttcctctgattcagcttcttctcgatcttcagtaggatcatacatgaatgtaatagttaaaacaaacgatagtgcaaatgccacactaattgcaagtgcatagccataaaaaccactgccaattccatcactaggactaatataatttggaagactaaaaacgcccattcctcccatgataaatgattttgtcccaaagaaccccatgatcagaccacctatggaagaagaaatcaaagttgcaatgaatggtttcttacggggtaacgttaccccgtaaagggagggttcagagacaccgaaaagactagaaataaaagcgggtataccgatcgcacgaacagaattatttttggatttaatgataaccgctaatactgctccagcagtagcaaatggagttgcttgtcctaaaaccattacaggatcgtatcctaatacaccaatattgttgatagcaatcgggataatcccccagtgaagaccaaacatgacaagaacttgccagattgcacccaccgctataccagcaacaatcgggctaaactgataaatacttaacacagcagcccctaaaatatttccaatccatgtggctattgggccaatcacgataaatgttaaaggaaccatcaataaaactgttagaaatggcactaaaaagctacgtaaaacgctcggaattaatttggtaatcactttctccaatttcgctccaaagaaagttgcaatcacaattgggataacgctagaactataactcatcagaataactggtatacccaaaaaagttacataaacaggtgactcaaaaatcgtaccattaaataaggtataaagaggttctgtattagcagttaaccctgacaaggccggatagaccattgccgcaccgatagccataccaacaaattgcttcagaccaaatttctttgctgcggtataaccaagaaaaattggaaagaaatagaagaagcagtcaccagcggcttgcaagatggcataggttccagaagtattttcaatccaaccaagagaaacaaagagaacgtttaatcctttgatcattccagtagctgccagtaaccctaatacaggtgtgaaaataccagaaataatatctataaaagcatccaaaggtcctttcttctcctttttttcttccgaggcttcgtttgataacccagcatagtcaataaactcttgataaacttctggtacgtggtttccgatgactacttgatattgtccaccactttgtactactgtaactacacctttcgtttttttcaatgctccagtatctgcaattgattcatcttttaaattgaaacgtaaacgagtaatacagtgagtgagaccggcaatattttcttttccacccacatttttcaatatttcctcaactaaatctttgtatgccattttattcatccccttattcataatcaaaaaggcaagacaaataattattcccaacaaaggaataattatcagtcttgcctgctttaccagtaacaacctctattcgttctctattaatttttgaatgggtagcgataagtataacttttcatcatcacttagagagactttcagatactgctcaaccaaaatcatcgttttgtaagctgctgggtattgactctgaatgtgctccagcaatggatttttgcttattcatcttagtccgggtagtcaatcgttggaagaaaaagcgcaaatgagtgataaagcgatcaaacgcaagcgaatcttcattgatttgaattttattagatagacgaataagtgaaataatatctctaattttctttgcaattagctggacatcttcaggttgatcgatctcatctgtcagctgagcattgatcaaatgcattgcaatattccctgcttcttcttcttcgaactggatacccgttttttcattaattaaaaatagtgcttttttccctatctcaaattctttgggataaaacttcttaatttcccatgaaaggcggttataaatactcattccctgtttgtgtaatttaatcaaatgatataaatgatcggttaaggatacatataatgtttcacttaactcatgctctagatcatttttagctaatcgaataatatcatcagctaaggaaacgtactttgccgggattgattccattaatgtcaaaaaacgttcagaagctttgtttttatgcaatacaaatactttctctattttcgtctcgtctgctgcttgtcccggtttcattttaaagcccagcccggtgccgatccaaataaaatctttgccatcttttccgaccaaaaccgcattattatttagaatctttttgatcttcaagacgtttctcacctccttaaaatgaaaaaaggctatacctcaatacatgtgtaggatccatacacacgtacaaaggtatagcctgcattatcagtaactacccatttgattgtttatactatactatttatttgattttcgtgcaagcgtttttatcatttttttctgcttgcatgtgttttgttgagtaaatactccattcctactcctcatccagtaaccgactttgtccttcgatcttttggatctctgtgatgtcttgcgtgacttccagacagcctagatatttccccgttggatttttcaacgcaaaatagcgaatatagatttttcgtccccgcatgtcaatccagaaatcagctgtttctcttttgtctgaccgaaaatcgtctaagattttttgaacgatgtgcatacttttaggtgggtggcaattcactacttctcgaccaatcactgaatttgtccgggggaagactcgactcttcccttcagaataaaaacgtacccgatcttcattgtccacaaacgtcaaatcgactggcaatgtttggaacatagcaatcaattgttccagctgcaaggaaccggtgggaaattgaacggtttggttcgtgggagcagtcgttgtcactggcggttcagcgaattctccaaacccaagtcccgcggcaataccagctgtggtttcttgggcctgtttgatggccaattgacgagctggctcccgttccaattctttctccagtgactcttggcttggtttccaaggcaatggttcaggaatataagcaaacccaatgtcaaagctatcttccgcgatccgttgccaatccgctaaactgaagacatccaatgtcataggaaccatgatttcttcttctttaaaaatcatttcttcaatttcagattttactgcctgccatttttcagcaagaggattatatgctgctttgtcagttgccaaatactggttcaactctttgatcatctcgcgaatatcatcgtcgactccccacatgactttcggcggagcagagatgccatacttctccatatatgaaaagatcagcgtttcttttcttgcataatgtttgtcgatctgtaacagatcctgcagtgctgcttgcagacgtcctttttgtgaccagtccccttttttgattttcttgagcaatccatcgatttcgtccgtcaataacgattgcaggacttggttttctagcttgagggtatggactggatgaccaggttgtccatattcttcatttgaatgatggatctcgttgatcgatcccttaaatacagccgcatgaatattgcatagacgttggatctccgaagggtctaaaccgctttgaatcaatgctttttctgccgaggtgatctcagtgacatctacgccgtcaaattcttcattgaataagcgtttggcttcttcaaaagaaccgccttgatgaagcaagctcaaaatttcgacgattcgttcttgccgttgttccttcgttctcatttgtcgactcctttcacaagaaaaccttgattttcaaaagattgaatgattttttccaaaggtatctttttcatttgtgcgcctttcggaatcgtcatatagcgaccggcagtttggagcatgccgggtttattgatggcagtaaagccaagtttgctcataatatctttgatttccggatgttccgacactaaatcaaagagattttttgagaaatctgcttctttcattcttatccttccttctactgagaataattctcaatcaactgcatatattatatacgaaattgctcacaattacacgatcatttccaaatttatctcccctcacttggcacaaaaagaaaagaaccacttctcgacctctgcgagcgaatgattctttaatagcaagatgaaactcttgatttagtgatagaaaataatcagctgcgatagcgacacacgcgattctctaatccatccaccacaccaaagaagaaaaagcccatcaatgcaatcacaacaatgcctgacagcatttgctcataatccattttagaccaagcactcaaaatcaagtacccgacgccataagtcgtattatagttttccgcaaagaacaaggaggcaagcgagataccaatacttacccgcatgctggcaaacaatgccggcatgattgctggcaaaatcaagaaacggatctgatgcagcgggttttgcgtgtaattttgcatcacttgaaagtaagttgctgggatttcttttaccccatctcgaatcgaaaccacaacttgaatcacgatcaccgaaaaaatcaggatcacctttgaaacattccctaaaccaaaaaaaatcatgaaaactggtagaaaagcgacctttggaatcggatataagaaatagagcagaggatcaacgattgctgctatttttgttcttccgagaaaaatccctaaaggtataccgatcagcaacgcaaaaaatagtgagatcaggacacgaatcacactggcccctgcatgtaaccctaattctgcacgcaattgccaaaatcgttggaaagtttgataagggtccggcagcgaacggttatccgctaacaagctgattccccaccataacaataaaaacgacagtgccccccacaaaaaagaacgtccggctttcatctgacttctcctctcatcttctttttcaatgccaatgaaaaagcataaaagtccatcgtctcacggcggttagcttggtggaaaactgggtttttgatctgatgtatttgatgttcttgaaccaataggatcgtctcgccaaggtaagccgcttcttctgtatcatgggtcactacgactaaaccgttcgcaagtcgttgttgctcagataaaatcagattttgcgtacgttctttggtttcctgatccaaagacgatgtcggctcatctaacagtaaaaatgctggactggtcactaatcctcttgccattgccactcgctgtttttggccgccactcagttgactagggaaacgcgctttgaaagaatctagttctaacgcttgtaagcacgtttcgactaacttttctctttggtttttggggactttttggatttgaagaggcatttctaccgcttgataaactgtctgccacggaaacagacgtaagtcttgaaaaaccaattcgatctcagaaggatggctatcgccataatcgatatgacctgattgcggcagctgccaccctttcaacaatgagagcagggtgcttttaccaacccctgattttcccaagacgacgtatgtatggcccttatctaaggttaaatctagattgttaaagattaagcgatcttgaaatgaaaatgcgactgattctaaatgaatcgccataaattggctccttctttctaaaaaattgttgttccctctttcacattctatgctatactgattgttgcgaaaaaaaatagaaagggatgcatttgatgttccgcacacttgtgtttcatgaaatacgaccagacaatgagttaagtgagcaaccaagaccaatcgaagttgccgatggctatcaagatgctcttccattgccgttattcaatagctgttctcattttaaacaacaaatcgactttttgaaagcagaaaaatatcatacccttactttggaggaagtcaaagactactatcttcaaaagaaagctttaccagaaaaagcggttttgttgacgtttgatgattgctaccaatccatgagggaatatgcctacccgttattgaaagaggccggcttcaaagcgaccgcttttgttgtcagcggttggttgtttgctgaaccgagcccttataagccggctgtttccaaaacactcagtcgctcggaattgaacgaaatgagtgatgtttttgaatacgccaatcatacgactcacttccatgaacgaaaaggaatgatgggccgctcaatgtgggaaccggctgaaaaatttgcggctgatttagattgctgcaatcaaactgtagcgatacaagatgtttttgcttatccctttggtttctatgatcaacagacgatcaaaacactagaagcgaaaggttttgtcttgtcattcacgacgattccagggttcaacaccctagaaaccccacgcatggaactacgaagagacattattcccttctcattggataagacatcttttgaacaattattcaaaaagacccattaagaacatcccttcaaggaataaataagaaagaggaacgaaaaatgaaaaaaacgattttatttacttgcttatcattattggctttagtagttgctgcttgcggaaacaattcagattccacttcagaaactaagacaactgacacctctgcgacaactgctgaagtgaccgatcaaacgttgaatgtggggattttaccagcagaatctgcgattccaattattctggccaaagaagaaggctattttaaagatttaggtctaaatgtagaaatcaaatcttttacttctccaaatgatcgcaatgttgccgtacaagccaaagaattggacgcaactatcagtgatgtgatgacagaagcgacgtttaagcaaaatggcattgacatgacaatcacttcggacattctagaagactttaaagtcttagcttcgccaaattcaggcatctctgaaatgaaaggattggctgataaaaaaattacccttgtaccgaacttcattttagaatacatcatggaccagtttgctgctgaaaatgattttacttatcaaatcgttgacattgcttcttttgcggctcgttctgaggcactattaagcgatcaagttgatggtgctgtctacacagaaccgcaagcgagtatgttagccgctcaaggtgcaattgttttgggcagttccaaagaagctggcatcaaaggtggtaccttgcaatttatgactgatgtggtaaaagatcgaccacaagatgttgccgcattttatcaagcttacgatcaagccatcgattatatgaacagacacaaagcttctgaatatgctgatatcttagccgactatcagttcccagatgccatgagtacttacttagatagccaaaaagaagactatccttatgctgccaaagtcccacaggaccaactagacaaaatcgtggcttggactaaagacaaaggacaaattgatcaagcttacacttatgatgaattgactgattttagtttcttagcgaactaattcctgatcacttattacacaaaaccaatactcgaatccatcaaagccagtgctgtgatagattcgagtgttttttatccagccattatttgacggatgctcggtcaccgagtatcattcactaaagggttgtgagcgatgaaaactactttatctgttcgtttcactacataagaaagggagaaaatataccatgcccaaaattgatctttatttactgcaaaagccagaagagacacaattttatgactatttacctcaatcggagtcttggcacagcgcctataaacaacttcatggtgaatccttggtgattcattcttctgttttgactgaaagcattctgcctttcattactcacccacttgtattggaacttctagagcaagaagatctcgcgtgcttgcctttagtttttgcagaaaacaacctttattgtaaggggcgtcttcctacgctcaccgaatgggaagaattgacacacgttggtatttcgattcaggaattagatgaatcaccgagcgccacgaaaacagcggtctatcatgatcttatatgatggggaaaactatctgctaaactgtcgttggtaagccttctcctgatgaaagattcggtctttatagctataaaaaacaactatgaatgagagtgaaattatggaaacgatgacttttgaagaattaatccaaatcaactgtttttctgaagaaaaagaagaacgaaagaaagcagctgaattattagaatatcgttatggctgcgagattcgttgtggtgagatggacaaaagtgtccgctttgctcaccatgctcgcggctgtacgatcattgctgcgaaactttgcgccaatgttgtgattttccagaatgtaacgattggttcaaatcagcggtttaaccggaaaaagaatgcctgggaaaatctgggcacacctattttagcagaaaatgtaatcgttgcagatggtgccaaaattcttggcccagtcatcatcggtgaaaattctgtgattggagcaggcgccattattaccaaagacattcctgccaatagtgtagcctttggcgtcaatcagtacaaaccaaaaaatcccgacttcgatcttatcatcaatgaccaaaatatccctggagaagagatcatgcggatcaacgcagaacgcgtagccgcatttaatcagcaaaatcaacgctagcagatcatccgattatcgctagcaagacaaccaaggaattataagcgatatgagcaaacacagactcccatggatttttgttgcgcaaatagacgattgtcagccaaaatccaataataaagtaagggtataacaaaaaaatattaccattagcattaacaatatgggcccacgaaaacaacaaaagactgcacaatgtcgtaacaattctcagccatctttttctaccagtataaataagcgtatagcgatagaacatttcttcgaacaatgggcctactactaatgcccccaatagtaaaggaacggttctctgagacgatggataataaaaagtcattgattgttcacctggaaagataatctggttgaagaaaaccgttgttaaaagaatcgctacaaatgtcagcaagcctatttttatcaatgagagaaccttcagttcttttaaacgatccaacaaatccctataaaaaaggataacaaagaaacaaagcaacactagcttggcgcccaactcatgatagcccattaaaaatttcgcataggaagaaggaattccatgtatggctattcctttccagataacaaaagccaaaagaaaaagcagtttcttcaagtcttcactcctttttgagtagtttcactagaattgcatggtgcttcgcttcacaattaacctctatcaggattcttctcgttccgttctttctcatgattctctttgggtagtttttagatcattctcagcatttttttactcacactacaattatacactataaaaaggtatcaaaaaaacattcatccgaaagaatgaatgttaatcagacatttttttactgaacaatgtcattgactgattggttttttaggaagaacagaaatgaccgttctcgcgaccaagagatagcaccagataacaagaataagctaatggccgttccttccctcacaaccaaaggaaatgaaaaagctgtagaaaggccgattgagattatgacacacagcacatcaacactataccgatattgtttgaaggaaaagcgacttctatcagccatcagctgacaaaaattttcaataggaaatttcaagtgattgagtcgcaacacttgtcccgtagcgagtcctgaaatcaatgtcccaacgataaaacatgtgacttgtgccaaatagtttggcactatcagttttggcagtaagccatataaaataccattgactaaattgccaaagaaaagcaatgctgccatcataatcaaatagttgatccatttccgataacggtttttttgactgtggtccagaaaccaacaagtgactaagaagagcagattgatggctgtcgtaatggttccgaccttgatacctgtgattgtggatagtgagacattcaatgaattaaagctgcttacaccaacagctgctttgattgtcaagctgatccctaatgcgctgataccatagaaaaacagtgaccaaaagagggttcgtttcatatgagatctcctttcatttgctccttctccattatgtggtatgctaagaaaaacaactaggagatttctcctagaaagagaggaaaaatgaaacgaaccctttatcctgttgccaaaaagtttcatcaattggacttgcctttttccactggaacattagaacagtcctctgtttacgagttttctcacaacgagatcatacaagaagaagccgggacactgactcacttgtacgtgatccttgaaggaaaagcaaagattatcaagtctcaagccaatggcaaacgatcgattttacaatttttgcattccggtgatttcatcggagatctgaccttagtgtccgctgaaaaaacgaccaaagaagttttagcgatcggtccaactgtttgcttggcgcttcctatcgatcatgccaagcaagtattgatgcaagacattgattttgtcaaaatgatcagtcaatatattggcgataaattaattagacggatggaacatttctccatcaatcagacttaccaattgaattatcgtttggcgctgttgctcttggaagtagctgtagcgggaatttatcaagaaaaactcacagaaacagcagaataccttggtgtcagttatcggcacttgacctacacgttaaaaacattcaaagaaaacgattgtgtctatcgtgaatctaggggttatcgcatcaatgaagcaaaccttaagcaattgattcgatcgatgcaacgcgaatagacacgctcttttccttctatcacgcttctttgctgattgcgcatgctatttgctaatttgagaatggccacagttgaatagccaaactgccagtccctgagaagacgatttggtcttgctctttttgcggataaagtctggaagtaaaggtatactccccattgtttatgaacacttccatcgatgaagtgtccataaacagttggatctgtcgtaattctgatagttgaatgcttctttttttgcgtccatagccggaaggcccatgagaaagagtaaaaatatggccatcataagagagaatcgtgtcttggcgcaagagaagctgcagtttttttgtctgttgggttagctctacctgcagttcgtagacctctccagctaattttggagcagtaaagctatcctttaactcgacattccagaagaaaggctttccacgtaatttttgatattctggcaatggttgttggatcaatcgttgtccattgaagctcagttctcgcggcaatgtcgccgcatgctgccatcctcgagtaacagtgggattcgagtattcaggacttgtgtcccctagtcccatccagccccataacaatctgcgccctttttgatccaagaacgtttgcggagcataaaaatcaaaccctcgatccaattccacgaaatccgatgttggcttaaatttcaaatttttccaatctacttcccctaataagtagccagactggtataaattattgaaagcataagcttgcggatctactccctgtggtgaaaaaagtaaaatatcttgtccgtcaagttgaaagaaatcgggacactcccacatataaccaagggaataatcatcccctaaaaatatcccttgatacgtccattgtgaaagatcctctgactgataaatcaaaatctttccttcactttcccgagttcgagcccctaagatcatatagtaacggccctctttttcaaatacttttggatcacggatatgatcggtaaaccctgcaggatatgcttcatgcgggatcactacttcttgtttttcaatcgaataaccatcactaatcacatggaccgtattttgttctctgccactaaaagtataatcatggtccccttcgtttttcacatttcctgtataaaagaaatggatctgatcatcctttacaatcgcactgccagaaaatacaccatttcgatcatacgaatgttctggtgaaagaaaaattgcttcttctttgaaatctaccaaattggttgacgttttatgtccccaatggggtgcttcttttcctgcaggattttgaggaacatattgatggtagaaatgataaaccccattaaactgacaaagcccattgggatcattcatccacccagtttccggcattaaatgaaagtacagtcgccagttatcctgagcgatctttgcttttagttccgattgttgttccagctcttgccaggcttcttttgcacacaaatccatccaccactttcttctctacaatttttccattaattctcggttgcgcttaacgtttgaaggtcatcctcaatcgttgtttcttcattcaattcatcggaaatctttctccgctgcagttggacgcaggcaaagcccacactaaacgcaatgaggatcactgcaatgtatttcaacatggcgccgaaatctcctgtatacaacaacaaaccaggaataaatgtaatgcccattcctgttgctgccaattgaaaaacatacgtcatcaagccgccgatggcccccccaaccatgccagaagcaaaaatacgcaaggaccgaagattgatcccaaacaataatggttccgtgatcccaaacaaggttggtacagctgcactaatggcattcgagcgtttgactttgtttcggtaaagaaaagcagctgcgattgctgccccaaattgtcctgccatactcgctgttcctagaacttgcaagacattctctcctgaagtatttaataaaccaagttcgatgatgctcaatgaatgatgcaaaccggtgataacaatcaattgctgaaccgctgcatataagatatagccaataccaaaaggcgcttgtacgaggtaaacaatgccgttgatcactgctttttctgcaacttgcaaaatgggacctaatgcaaataaaactaatgtcagcgtcactacgatagtcagaaatggggtgacgactaaatccatcatttgtggaacaaattttctaaatcctttttctaatttggaaacaagccaaccaacaataattgcggggaaaatcgaaccttgataccctgaaatagaaagaccgaataaatgaagcggctgtgcatcgccactagcaactgcccaagcattgggtaactgaggagctaccatcatcaaaccaacaacgatcccgatgatcggattaccgccaaattttttggtggcactataagcaatcaatacaggtaagaaagcaaaggctgtatctgtcagcatttcaaagagcgcataccagtccgcactaaaaggaacccctaattcaactagcagaccacggatccccatcaaaagtccagttgtaactaatgccggaatcaatggcaccaacacatcagaaagagtacgaacaactttctgaacaggcgtcagattggaataaacatcttctttaaaggctgtctgctgctcaccatctttacccattgtttgagcaaaagcctcataaacttcatttacttttccagtcccaaaaataaactgatgctgtcctgtattaaagaaataacctttgctttcagaaatgttttctgccttctttttgtctagcaacgcatcatttttcaaaataatgcgtagtcgagtggcacaatgctcataatttttaacgttttccttaccacccactgcttggagcaactgatcaatgattttctgatctttcattttaattttcctccatttcaactcactttattttgtggaaccggttctacaagaaggataacagaaaccgtttgcaaaatcaacccgttttatcaaaaaaaaaaagactgtgacaaagtcatcatccaacaagttaaaccgaatcatatgctattgtgatagattcctcggacttttgcgacgaggagccactgcaccgcaggagccataatagagactgtgacaaaatcatcatccaacaagttaaaccgaatcatatgctgttgcgatagattcctcggacttttgcgacgaggagccactgcaccgcaggagcaataatagagactgtgacaaagtcatcatccaacaagttaaaccaaatcatatgctattgcgatagattcctcggacttttgcgacgaggagccactgcaccgcaggagcaataatagagactgtgacaaagtcatcatccaacaagttaaaccgaatcatatgctattgcgatagattcctcggacttttgcgacgaggagccactgcaccgcaggagcaataatagttaaggttcggatagtgttacttgtcggagacttatggcacagtccctttcacgaatcattatggtatttgttctatgggaatcgttgattgtttgatcaccagttgattcggtaacttaatcaattctggcacttgaactttttggatcaacttctggatcgtttccaccgcatcgacacctaactggtggtaaggatagtgagtggtcgtgatcgtcggaaagacataatccgtcgaatcatatccaccgaagccgctaagggagaaatcctccggcactcgcaagcctaactcatgcgcggctttcaatacggcaacagcaatgttgtctgtggcacaggctaaataggtcgcttgattctcttttagaaataagcgagctttttgataggtttcacttctggaaaaagacgtttcgatgaaagataatttggtcccttccatttgagcgaccacatccgtaaagcctttttttctcaagatccctactgcttcgtctttttcagtcactccgataaacaaaaaagaccgatggccgagttcaattgcatactctgccagtttctctcccgcacgataatcatcatggacaatcgaatggactccttgtaagtgttgacccaacatcagtacaggaacggtcaattgctgcaagacttgtgctagctcactcgtgatctctctagccagcataatgataccagcaaccttttgcttgaccagcatctcaatattttctaattcgcgttcttcattttgattagaattcgtgattaacaattgatacccattctttcgagctgtttcatcgatcccttctaacacactgttggtggaaggagaatccagcctaggaatgatcactcccaacagttttgtgtcttgtgcttttaaactgcgggcaaacgtattgggccgatagccggtctcttcaataattgcatcaatttttttacgtgtttgctcgctaacatagccattattcaaatagcgggaaacggtgcttttcgcaacgcctgctttttcagcgatatctttaatcgttaccgttaccatagtcaccctactttgctttttcttttattataccaagaactgaaacaaaaataagcactgattctctttcggatgccattcacttcatcaaaagataggaagccacaaaaaaagatgcttgctactcatgaaagagctagcaagcatccgtttatttctcgtgatcaaacgttcaagatccacataaaaccaataaagacaaagaataacacatacatgatcggtgaaacttctttaccacgtttggccgcaatcattgtgattggatagaaaatgaaacctagcgcgatcccgtcagaaatactataagtcaaaggcatgcctaataaaatcagaaaagaaggaatcgcgatttccatttcatgccatttgatttcttttagtgattgcgccatcagtactccgacaataatcaatgctggtgctgtaacctgagaggtcactactgataaaagcggagaaaagaatagaccaaacaaaaagaaaatacctgtggtcacagctgttagtccagaacgaccgccgacagcgatccctgctgaagattccacatatgcgcctactggagaagttcctagtaatgatcctgccaacatcgctgtcgaatctgacgctaatgctttccccactcgaggcatcttattgtctttcatgaaacctgcttgattggctaaaccaactaacgtaccggcagtatcaaagaaagtgactagtaagaatgttaggacaacgacccacatttgcaatgtgttgatgtcaccgacatgcttcaatgcgactaaaaaagtcgacgacatactaggtgctgccgaaacgatcgaacttggtgcgtggatcaaacctgtcactaaaccaagaatggtcgtcgctgccatcccaatgaaaatcccgccaggtactcgacgaaccatcaacacagccgtaatgaccaagccaaagatcgttaaccatgtcgtacctacactcaatgatcctaaggcaactaacgttgaatcgtcggaaacaatgatcccaccttcactaagaccaaggaaagcaatgaacaagcctatcccaccagaaatagcatatttcaagtcggaaggaatcgcatcaatgatcatttcacgaagtttaaaaatcgtgattgcaataaaaatcagcgaagcgacaaaaacaccggctagtgccgtttgccaaggcacacccatcccgatacagactgaataagaaaagaacgcgttgattcctaacgcaggagctgtcgcaatcgggtattttgccaagactcccatcaaaatacatccgagggcacttgctaatgctgtggctgtaaagaccgctccctcatccataccagaagcaccaaggaccgttggattgacaaaaagaatataggccattgaaataaatgtcgtgaatccagccaagagttcccgcttgatggtcgtgttgagctcatcaagcccaaaataagagtgaagcacatttttcattttttgaatcctccattattcagataggcgcgattattttccctctgaatccttaataaaacaacgaaatcaatgatataccaacttttcctccaagtaaataaacttttctaaaaatttcagaactattttcattttcatttaagatgctaaaaccgcttatttcccatacacagtgcctcatactcgttatgcttcgattgtaccacttgaatagtaaaaacaaaaaaagtctgtactgtcagaaacaaaaataggcagccaaagaacgatcatcttttccgcagaaaagccaatcctacctgacagaaagatcctatcaggatttcttttgctgacctattggttaaactgtttttgtgaatgatcaatccacaaaattttgctcttcctcaatcaaaatctttaattgttctgctgtcgttcgtttcattgacaacggcggcaactcttccaacgtaaagaaaccactggcagaggtttcactgttcgtcacaaaagaaccttctttgatcgaacaggcaaaaactaatttataatattgaaacaattgtggaatgtctttgcgcagattagtatcaaatactgcacaaagtttgtcaacttcaacaactaatcctgtctcttccaacacttcttttataacgttttctttgggtgagaaaccgacttctgcatagccacccggtaaagaccactcttttgtatgaatgtcttccactaataagactttgttatcctggcgaatcaatgctcgaacatctacttttggtgttggatacccttcattggcatctagcacaagtttaagcgtatcggttgtttcttccgtcgatcggctcatcaattccactagaatttctttcatttcgacataacgctcttgatcataaatatccttgccataatagatcccagcatcagcgattgctaacaatcgctgatacttctcaaaaatctcctgcatctgctcccctcgctttgtgctctgtcattctctctttatgataaagcaaattctggcagatagaaagccagacagcactaatttctaaagtcagctagcataattcaacaagcaatcattctttgcgatagatcatgctttgctggatttgctttaacgcaaaatccatgagaaaaatcaatcccatagccaataaactaccgatcaatgttcccgagaaacgccaaggaatcagatggagtggtacaaaactactgccgatagtcatcaaaagcagcacttgcggattggtaaaaaagttggcgatcgtataattgacaggcatgaaatattccgtcaatacattcaatacaatcaaaatagcagcttttgcttctaatggtaaatccagtgccatgagtaagaaacctaataagagcccaactattcctcctagcacacgaccgattgttctttttttgatgttttccatatgttcgccagcgagtaccgcggctgcagaaatcaagatccaataaccattgcttgctctcaacagatatccactataagtagcaataaataaaatcatcgaaaaatgcatcgcttttaggatcatttccggttggtggtaaagagcgacataatacttatctttgagagaaagctgctgaaagcgatctttgggtaaatgaaaaggcagcctttctgcagcggagatcagcaacccagccgccagagaacctacgattccataaagaagataggagctttgatgaagaatcgccagtaaagcagctgtcacattctgtgtttgatggtgaaaattgaatcccgttgcgtagagcatcagtacaaagaaataatctggttttggcaagcggtagattttggaaagtaaaaaagccgtgaaggacaagcagccgataataaacggtgcactccaaggaatcaatgaagtaatcgcccctaaaataaaggcactcaacaatgcaaaaccgtggatcaggattgcttttatattgtaactgaaggaacggtgctgaaaagccaaataagaaaaagctcccatggctccaacagaacaaatcatggggtctttggaaagaatcccagtaatcaaaggaacgcccattgcgatgccagagcccaatggacgtaatagtttggtagttaaattcatgacattcctcctctagcccctattgggagcgacatcttttataagtggttgtttgggaaaaaattagtatgtaaatgatcagaagaaaacaagatcttcaatgaaaaacacggcataactgatgaagcaagctatagaagatggaagatttttaacaatgaaaaaacaagcagcgactttctagcagagaggcaacggcctctctatcaattataggaatgaaaatcgaaacatgcaaacttttcaagaaagtttcgtgaatcacttgatctcagttaatctatcagaaaagacagtgctctctcattgccgtcaattatacggttcaagtgatataaaaaagatcaaaactattctggagcaaacaagaagttgcactcagttagttttgatcgaattattttattcctctatctcctttaggataggaaaaatttagtcctcttttattttacagatgcactagaaacagcatcgactacgacagcctctggcgcaccagttgtcgtagctgactctgcgttatcttcgtggacagaagcactggtaacagcatctgagttctcgtgaacagaagcgctagagacagcatcttcgtttcccaccaatttttgaccggtttgttgcagataccattcaatgattggtttgaaatctagaatatactcgttgatacctgcatattcgccattttcatcatgcatggcttggtaattgtggacgatgtatttctctggaacctgttttggtacatgaacccgaacagcatctgtagcgccgctgcgcaattgttggatcacccattccacatttttatatgatttttcagggtgacagtttgctaatggattgcccacctgaccgggaacacgagctgccaacatttcatgggcttcttgacgcaagttataatacaagaattgattattgctatccgcaaaggtcaactccatcggcattgaatctaaaaagtaattgatttgatcgacggtcaataatccacgatttaactgaacgtaagtatttccagaaacggcccctactgcttctgcagctttctcaagccattgatcatcagacatatcaacgccttccaccgttgtagcgatcttcccagtcgcatgtaaatcttctggtggcaattgtttaggtccagctaatgcagagactacgttaataaatttgacgaagcttgctaacgtgctgcctaaaaaatcaattgttcgttgatcgatcagattcccatcttcatcaaaagcttcttttgactttcctagtaaaaactcattccccggcatcacaagtgcattgactcctggggcatccaagatttgacgcaaatgcaactgtgatctggaagttccttgatcataatacgaagcacccacgaccattactggcttattttcaagaggatgaatcttaaatgaaagccattccaagacacttttcaggcctgctggtactgtatgattgtgttctggtgtagcaatgattacgccatcggctaaaatgatttttcgatttagttgctggatctctggactgttcgtttgatcatcatcttgattgaataatggcaaatctttgatttcgaccagttccaaagtaaaaagttcggtgaattgttttttgatgaatgttaataattttcgattggttgaaacttctgctgttgatccgacgataccgattaatttcatcttttctatctcctatcgcaattaaatggtttcccaagaaaaattttctgcttcacgtttattagcttgatgggcatgttgtaactgacttgtgatcgtcacaaacaagagaaaatcactgaatagctcccgcaattttgttacttgctcttcatctttcaggcgtccttgttcatcaaaagcttgcaatgagtgccccaaaagaaattctgaacttggcatgatccgtgcttttaattccggtgaatctaaaatctgccgcaaatgagcctgtgctctggaagaccctagtgtgccatacgacgcccctgtgatcataacgggcttatcaacaaaaggaaaaataccataagaaagccaattcaaggcattgatcagcgaagctggaacggcgtggtcatattctggggtactgatgatcacgccatcagcagcttcaattttttctgcaatccttctgactgcttccggcaactcatggtcttccggcttattgaataagggaagaccggcgatttcgacaagttcgatctccgcttcactagcaaaaaagtttttcatgaagtttaacaaatcgcgattcgttgatcgtgatgagttggttcctactaagcctataaatttcattttttattcttcctttccaaaataattttctttgatccctgacgtgtggcagacccgattctcccttgtgacaaagattccttcgattccggtctgagctttcaattgatccaccacttgaacgatcggtttaccaaataaacgagttgtccagatttctccttccaacgatgacttagaaacaatggtcagactcgctaagtcacttttggttggaaagcctgtttttggatcaatgatgtgatgataaacggatgctccttgctgtaaatagcgttcatagataccagaagtcacaagagaggcattcttgactttgatgatctccaatgattgctgccttgttccttgggggtctcttatacctatacgccaaaaaccatcctgatgttttggagacgcgccataggtcacgatattaccacctaaattgatcaaagcataaacagcatggttctgatgacagtacattcgtaatttatcagcaatgtagcccttagctaatgaaccgaggtctagcagcattccctgtttttccaagaagacactttgctcttcctcattcagacgaatttgttgcgggtctgtcaatggcaatagtgcagttacttctgagggtgtgaggacttttgcatccgtaaatccgatccgccatctttggacaagaggaccaatcgcaatattcaagtgactgtctgctgcacaactatgatatttgccgattttgatcagctcataaagttctggatcgacgaccacaggatgttgaccagctgcgtgattcaccgccatcaattctgagtggggatcgtttgcgctaaatcgtgtttcatattcatgcagcaggcgttctaattctgatagcaaccacattggatcgttatgggcaacttgtaatgtgatggttgtacccattctatgaatgacccttgtttcttctcgaaaaaagttttcacccatttgtatcccttctttgattccaaaaatcaaacgactcgctagcgaaccatcatttttgttagtattttcacaatcagagaatactcctttaaaacatttttgtcaatatcattatatatttttttatatacaaaaccgcgctaatcttatataaaaaaaagaacaaccttcgatctttcgttgctagatcaaaggttgttccctataaaacggatcaaaaataacgactcattttcatttgctttagtcatgcatcattatagctgttttttcatctgatttaactcattgatcaacagccgatttttgttgatttttgcaaacgcaagtgcatcttgtatcaattctagaatgacagaagctggttcgccggcagcttgggcatttttggccaactgtgcagctgcacgggccagataataggtcaaatgattctctgagcaaatggcgatcgcataatttaatagtgcgttgctggtttcaagatcattcgtttgcgcgtaaaaaaccccgcaatggaaaacgatattcaaaacgcgccagatgtcttccgttgtttggatgggatacgtataaatttcgctaaatactttatcgaaatatacttccgctttttccaactcagcttcacgcgcataagcgatgccgatccccgtgtaggccagcagttgaaatactgtgtcggtcgtctttgacatcagcaattgatcaaaatggaacaagacatccgtgaacggcgcctggttaaaaaccatctcgaatcctttaagataataataacgagctcttaaatcggcgtctttgatcgttttgggatcgattttctccaaaatttgagccaattgttcaaattcactggtaatcagcgaaaattcagctttttctagttgttcatctagttgtgaattcaccacattgattgaagaaaaaagatccactaaaggcagattgattcgattgcataacttgatcaatattttcaaggaagggacttgtccattattttcaaacctgctcagagttgcttgtgtgcaaataccctctgaaagttctttttgtgacatcccaacagcctttcgtgctgcaataaatttctctacattcaattgcctttcccctctctgcttcaactttggcagccattcagtatcgatatgattttagcatgtttttttgaaaacaggcaccctcttttgattttatttttcacttgtgaaggggaagattctatggaacaatcacttttctgagaaatcgccttttacgacagcccgctgggtttgatagcttcctttctcttttcctgtacgtatctcggctagctttgtttcgatcattttcataattttgttcaagttttgagggtctgctacaaaatctagttcatccccattgatctgcattttcggacagacatcaaaattttcataccaagcatcataccgttcgttcaacaatttgtagtaatcatacaaacttggatcatttgccacctgttcatacgaacgtcctcgcttaccgatccgatcgatcatagtctccaaagaaactttgatgtggatcatcaagtctggttgtttcattggggcggagtcttccaactcacgcagcatcgtgttcaataaattgtcgtattgctcgacttccattggtgagatccttccaagatctgcattcaaatgaaacatcatgctgtcttcataaatcgaacggtcgatcacattgtcatcgtgagacaaggcttcccgcattgcaagaaaacttttattcaaaaaaaagatttgcaacaaaaaagcatatctttctggatttgagtagaacaatggtaacacatcgttgtcctcaacattttcataaaatggttttgaagccatttccttcgataaaaaatcggtcaaactacttttacctgctccaatcgttcctgctatcaataacacatgcatccatccttcttactaaaatatcgttgagccatccttgtctcgctttttccctcactgataaacctaacactgaagctgattcaaaacgtaggcgtatctttacatggcatttggttagcagcaaaatactcataaaagaccttgtttactgatttctctttgataacaaaagatttctcgcgactaatgtctcagtggcaacctctctagtgtatcaaatccagcacgtattacaagattgaaggtcctttttccaataacgggcactcttctgctaacaggttgtcgtctaaactcgtgcgtttctcagagtcgtaatggcggattctttatgcttgtttgcctcacttcgacacaaatccctgctaaacgattatgacaaaaacagcgctccttccaaacttcaagatccattttacctaatctttaaaaaaagtaaatacaatatatagtgaacagagtgtaagaaaaagattaaaaaatactatatattgtgaagtaatggtatctaaaggaaggaaatattcagtcactgcagctgattttgttattcattttttcccccaaaaaaaacacaacacctgctctcctatcagaaaaaagagcaggtgttgtgtttaaaatgttgctattccacttcaatggatcagcaatcagtcgtttttgtccccttgaatcaaaaaacaaactctagctagggtatatcctttgtgtcagtgaactgatttccgcctctttccactaaagaatatctttccatgatccttaacgtaagatttcgatcgttttctcgattttaaccgttacacgaccgttcttgatcacataaacccgttcgggaatatcaatcaatgcattgcttttcgactttgtatctaacaatacaagatcggcttttttaccaacagctaatccataatcagctagtttcaacgctttcgccgtgttggtagtgatcatcggtaaaaccgtcggcaagtcggcagccccacctaagtgggcaactggaacagctagcatcgcaatctgaatcaagtccccattcccataaggtgtgaaggcattgcggatgttgttgcttcctaagcagatatttacaccaccatctcttaatttgcgaatcggagtgactgcacgacgcacattataaggatcgtttctcgcccctaaatgaagatcggtggcagacaatggcatgacattgatttgtgcttccgccatcaatgagatgacttctgctaatttttcaggcggcatcgcatgcaacgcggtcaaatgacctacggagacacgcccgtgatagccttctttaatggtcttctcacacagataaacaattgatgtctcatccgcttcatcggcgaaatcttgatggagatcaatgtctttatcaaactgtttggcaatcgaaaaaaccaaatcaatatgctcattggctggtgcatcattataaggaattccccctacaacgtcggcacctttttccattgcttcgatcatcatcttatcagtaccaggcgccttgaagattccttcttggggaaatgcgacaacttgcatatcaatcaaatccttgtattcttcttttaatcgcatgatcgtatcaaagcccgtaaatccttgggctggatcaaactctgcatgagtccgcacagctgtcgtaccatgaacgatcagcatctcaagtgcttgttttgcccgttggtatatgtcttcctctgtgaaagttggctttaattttgcagtaaccgcgatagcttcttgcagtgtgccggaattgttgggttcacggtcagcgatcaatgctttatccaaatgaatatggctttctacaagaccgggaatcagcactcgtccattggcttcgatggtctcatttgcaactgtttcgatggatggtgcgatctcgacgattttgccagcagtaatgccaacgtcttttaactcttctccatcctcgattcttgcttgtttaattagtagatccatttcttttcctccctcttacttacccaaaaatcaaaccaatgaacaacaatataattgaagcaagacttagccatttcacatttcctttgaccacatccaaaatggggatttggaatcctgaagataatgcttgcatcgtgatgttgacgaaactcatttgactgcctaagcccacgcccattgtgacaaaacctaaagcaatcggtgggaatcctagggaaacggcgactggcaaaacaagtgtcaacactgagcccacatacgctccagcaggaatgccaatcaagactccggttaaaatcgccacaggtactacaacaaattccggtgcattttgagctaccccagcaatgacggcaaacgttcctgtttgcgcaatgatattgatgaatgccaagaagattcccacttgaaaaagacgagtcagaatatacgttgatccatctaccattgcttccaccgattgattcattgaaaaatcagtacataagtaaatcaatgctaatgtgatcaccatataaacaagcggtgtgaagaaaacaaaaccaatcaactcattgactagcgggccgaatataactgcaaaaagcaagaaaatcgctggtaatgtgattttgaacaactcgccattactttttgtttcatattcattttctgcagaagctttaaagccgatgtgccggcgcttcgttccccaaaaagccaaagcgatagctaacacgacaaacaacaaccaaaaaggacgcatctcaacaacataagaagaaacgctaaagccgcccagtttggaaacaatacttgattctaaggaggcaggagaagttgtaaacgagacagctgccgctagcgacatggctgcaatcaattctggaaccactcccactgctgcaaaagccagtggtgcgatcaccattgcactgccgccgccaataccagacatataagtagctgctgcaagcaaaatgacaataaatgcagaaacatattctaccttgccttttgttcctcgtttagccaaagtcaaagctgccgtatagcttcccgctttgaaaacagccattgccacagcagaattgatgatggggacagtgatactcaacatcgttggcacagcttccagcagttgcgtattggcttctgctaaactgatacctccgatgatcattgctagtataccagcaaccagtccagcaatgatcatatctacctttctaaataaaagaactaaaaccaagaccaatggaactaaaaccaaaatagctttaaatcctgttggtgcaacgatttggtcaattgcttcttcagcatgtacagcaatgccataaaacattcctacaaacatagcagcaagcaaaaaaacccattttttaaatgttttcatttttccacgtccttttttggataaaaataaatgcattgaaaaaaacgaatgattcagtctattacgtaactagcaaaataggttattccatttagagaaactcaaacggggcctgctttctccttttataaaacaattactgccgattacctattgaaatcaaaatgagatcactcttaaaaaactacccctttcactacttgctattcagctacaagttctctgagccactcctccctaagaatcattccctgcactgtccactactaataaacggccacaagatgccgttggtgaatcctttgaagttgtcggacatacaaatacaccgcttttttgtgggaatgattcttccttttctccttttctgcctatcttcctgttttctattttacgcgaatgtgaatccgctttctttggacgttattctaaaaaaaacgatctttttttagccgattgtctaaatcatttgcatcaaagtgaaacaaaagcggctgttctgcctattctgaccagccacttttatcaattatctggttccactgaagaatcgcttaatccgctgatagaccagcaattgtttgcgggcacgttgaatccggcgataccgatgaggatttttttggtaaaacccttgatggtaattctcggctggccagaaagtcgtggctggtctaatctctgtgatgattggttttgcataatgacctgccctttgcagctgttcttttgacgcttcagcaatcgcttgttgctgcggatctccgacaaaaatgattggtcggtactgctttccccgatcttgaaactgtccaccagcatctgtgggatccgtcaactgccaatacaatgagactagctcctcatacgtaatcaaccgattgtcaaaaatgatttccactgcttctacatgtccgcttaacccgctactgacttgatcgtacgtgggatgcgggatattcccgccggtatatcctgaaagaacagaagtgatccctattttctgttcaaaaggctccaccatacaccaaaaacaaccccccgcaaaaatggctgtttcttgatgactccagtcagtgatttgatgtgtctttgttttttgagttgtttgagttgtttctatccctcttaactgatcataaaaatcctgaaaatccggtgtcaagttgcctcgaagtgccaatggtcgcaaagcagcttccaactctgataggacatttttttgttcttgtccggattctaaccgatctcgggctgccaacaactgggatcgttcccaatctcttgtccctggattgatgatcaaattgtaaagctgacttaatcgttcctcgtccatccttctcatcctctctgccagcaaaactttgaagtgttccatcctcttgcaattacttgaaatgatttatatgcaaattaccatatttccttcatctggcctactgattcgctttctgaccaaagaaaaaattctctaaatgacaaaaaaaccgaacaaatagcggtacagaccatcaacataggagggtctgaaattcctgtagaacagaaatcagctatcgttcagttcgaggtattttgctgtttggttatcttaagagcattgtttatcttgttagtgaaaaatacaatggacttaattcttctaatgcttcagtcgtcaatctctcaacatcttcgatgctctctgatggaaaccaaagtttgccgatttgaaaactgcgtccttgcagcttttcttcaagttgtctttgtttttgcggctctgagaggtatacagctaatgggcaatgatcttctagttcatgttccacctgtggccaaatataataatcagccaaatttttgtctttgctccattcttcaatctgccagcgtaagtcattataggctgctaaactccctgaacgttggccacttttgtaatgttggaacatgaaatagacttgatattgcttttgattgatcaatgcagctaggcaggcattttgattcggatgtgcctcattccgataagcacaccaaaaatgactgcgcaaattccaaccattcgtccaactctcaactttcggttgaaggtctgctgatacattggttgcgacagtcatttggatatgtttccatttttgccagctcatctgataatcctctttcagccgctgaattgtttctggtgggtagatgtctttgatttgtttaaaggcaaatacctcacgatcgaataaatcaaaatctgccttagcaaattccataatgtcaccttacttttaagctctatttttttagtggtagtaaacagcatctaggaacaatccttgggaaggcactgtctctccggctgcttttcggacttgattcgtaaatatctcatcgatcgccgaaatgtccattgtacccgcaccaatctctaaaatcgtcccggtgatgatccgtaccattttataaagaaagccatctcctttaaagcgaaaacgcagcatatctccttctcttgtgagtgagagttcctcgattgtacgagtagtggattttttggtcttttttaatgcagaaaagccaataaaatcatgagtgccaataaacttctcacaagctgcttgcattttgtcccaatcaagctcttgcggacaatgaaaactctgatgacgttcaaatacggttggaatcggactattccaaacataataactgtattgtttgccggtcgcattgtaacgggcatggaaccgttcagaggcttctgcgacctctttgatgacgatgtcttgaggtaggtagcgattcaggaattgcaacattttttcgggggacaaatcgcttgctgtcttgaaattggctacttgtcctctcgcatgcgtccctgcatctgtacgtccagacccgatgatttcgattttttcatttgtcatttgtgtcaaaatactttcaattttctcttggatcgttcgatcagaatcgcctaaacgttgccaccccagatagcgcttgccatcatattcaatcgtaagtttaatatttctcatttatgttaattgctcctgtcatcaatgatttaccccaaaaaaacgggttcccttgcttatcataagggaacccgtcaccggtgtaaatgctctaaagaagattttagcgatatttcaagaaaacagccaaagattcaaatttctgatgtcattaaaaacttttatttcccaatcactaatctccttgtatagactgcttggcccgaatgcatgactgcatcatcgacgatggagacgatccgagcttgtcgtgtcacagctggcgtccagttctcatcaatcacttctgataagctagtttcatcgatagactgaaggtaattaactgctaactcgacactagcagaaagataatccactaatagttctttttgattaacaattaccttggcggcttcttctggtgtatgacgccaatcttctgtatcgtcaggcaaatccaaagcaaatcgcttcgtccagtccgctagccaaagtggttcttgatccgctaatgcggaaatctgcagatcgatttcgcgagcggtatgccagatcagccaagtgactgacttaatcagtggctccggcatcgtgttcgcttccgcgatactcatttgtgccaacgtttcttcaaatcgttcttgggcccgttgcaatgtctcgatcgtcaattgtgtttccttcatgatactcctcctctttagtaagtgcttatctttactctactacagaaaaagggagaaaccaatgaatcaacctgctggtaaaaaggactgaaaaattattcttccgcataaatttctttggctaaattgaatgccgaccatgctttaggccatccggcatagaaagccaagtgtgtgatcaattcaacgatctctgcttgagtcacaccattttctttggcgattcgtaaatgagcttctaattgaggcacaccttgtgtcaaaaggctggcaacagtgatcaaactgcgatctctggcggacaattcttgttctctagaccacacttctccgaataatacgtcatcattcaatgccgcaaactgaggggcgaagtcacccaatcgttcgcttcctgctgtttgttttttcattctcattgcctccttatttttgtaactgctgatagtcttcctccgccacagcttcgagccattcaggcgttccggcagtaatagccagatgttcaaaccagctatcttttgctgcgccatgccaatgcttgatgccatcatgggtgacgacaatatctcctgctgtcaaaaattgggctggttttccttcttcttgataccagccttcaccaccagtaatcagcaaaatctgataaccatcatgatgaatatgccaattgttgcggcaacctggctcaaaagttacattcccaacgccaacattgaccgaggggtctgcaactaaagtgtttaaataactttgtccaacaaagtattgggcatacgcttcattttttgcgccacttgggaaaatcacgccatcttttacctcttcaaattttgccattgcttgtctcctccttgcatacctctttgtctgataccattgtgccattttgtcagctttcacaatcaataaagcggcaatcctttcaataacttacaagttcatgttactgcttgatccacataacgtccaatacttgttaagctgatttctatgcttgcaaagcatgcttgaatttcttcaaaaatgtttggactgtcggcgccaaaatcgtctctttcctccataccagaacacagttcgtttccagaggtggcgaaaaggggatgaattttatttggttttctcgatgatgaatcgctccagcaattgctaaagcagcaccaacattgttttcgaccaataaaagcacattaaaaatcaaattgtatctcccaacgattgtcaactcttcttcaacgaatcccccccacgtgcaaaacatttccaaaacttctttacgactcgaacaaatcaacggtgtggtgaggatgtctgcaggtgagatactgctttgatcagccaacgggtattcatttgcaacaaacagcccccagacttctttcttaggcaatggtcagccgattgtattgatccgtcgttgcaggatcaatcaaaatcgccacatcaagcaagcctttatcaagtttttccagaatatcattactagttccgctaaaaatagtaaaagacacttgggggtgatcagtaaccatttcttcgatgatttgtgtgagcaaataggagttttctgcttccacacaaccaatcgcaatttgtccattcagaatcgtctcctgataattgaacaattcttgttctgttttctgattcaattcaagaatttcttctgcgcgcttttttaaaaacagacctgcttctgttaaataaagtttcttattttggcgcacaaacaattctgtgtgcaaacgctcttcaaactctcaaatttgtctgcttaaagtgggttgcgtaatgttcagctttttagctgcttgggtaatattttgttcctcagctattgctagaaaatactttaatacacgagtttccatcgaaaactcctttcttctatgacacaacatttttcctactgttatctcagattttcgggaaaagaacgcatccttatttatctgtaacaacgaatactagctttattctaccacctaactagaaattcttgaccgctattcgtttggttcatccaaacaaaaaggcccttcattcactgaagagaacgaaggaaccgatagaattgaatttcagttgtttctaaaggacgtttttattacaagcgaatcggtgtagcagtcttttgcagaacattgtttagcgcttcaatatttgtacgtccttgggtctgcagccactctttcgccgcaccttctccctgagtcacaaaaggctctacaccgtttgcccaggttgctcgtccacaaagtacgccattgaattttgagccggatgttttggcaaattgcagtgtttcttggaacaattcagctgaaacccctgcactcaagaaaatatagggcagatccgttgcttccgcttgctctttgaaataaaccgccgcttcttcttttgtataagcagcttcctccgcatagccctctacatagttcatattcacagggacttccactttcaagacatcaacgccatagtatgcttgcgaaaattctcgcatcatatcatttactttatgaggttttttcaaagcatattctttcgaagtggtatctgggatagcagcatcataagaaaccagttctaagaaaaatggtagattttcagcaaggcattccgaaccaatccgttcgataaatgccttcttttgatcattgatctcgtcaggttcgtccacatcataatagagcaaaaacttacaagcatccgcgccattttcttttagccgtttcacagaccagttggacaaaagatcaggcaaacgacccggagttgaagcatcataaccggttttctcgtaggctaacaataatccagcttgttcatcccgaacttgggctgctggcaatccatactctggatctagtaaaattgctgaggcatagggcgtcaactcggctgacacgatttttttgaaggcactgatttgctctgtcgtgactgaatggtcttggaatctgccaatcatttttttcaaagcccctcgttgatcaatggctaaagcactaataatgccattttcattacatagctgttggatatatgcttgcttatttgataatgtcatgctttcactacttccttttttagttttctgccagttttccatttaaaatttcggcaatttcatcaggagactgtgcttgcttcaaacaatttgtcacctctttatgcatcaaaagccgtgccacttgagacaatagtttcaaatgtgtcgttcccgcttctgaatcaggtataaaaagagcaataataaaatcagttccttccccatccaaacttttccaatcgattttgctatttaattggacgatgatgacattggcttcttcgatactgtgatctttcgcatgagggatagcaaatccatccatcatccccgttgtactctcctcttctcttgttagcaattttctataaacagcagcttgatcactgctgatgcctagaataactgcttgtgctgcaaggaaggtcattatttcgtcttgtgtcacaaaatctcgcttcataaaaatgtggtctgttttgatcaacgtcatttgtcttcctcttttctattctttcgctgtttctttccattcatcagctgaaacttctgcttcacgtttttgtacactgcgtttttggatgaaccctaaaatcactccacctatgatcgagccaagtaaaatcgaacctacccaagcaattttccccgtgacaaccggcaatactaagaagccgccatgaggagcaggaacttggactccaaacatataggtcaaaaccgctgcgatcgatgaacccaacatcatcgtaggcagaacacgcagaggatctttggctgcaaatggaatcgccccttcagtaatatgcgttgatcctaaaataaagttgactagccctgcattgcggtcgttcgtatcaaaatatttcccaaaaaataagacagcaaatcccgtaatcaatggtggcgcgatacatgccgcagaaacacctgccataaaggtatggtttccttgagctaacaatgccgttcccgtaacgtaagcggctttattgacgggaccgcccatatcaaatgtggacatacagccaacaatgatgcctaaaatcaatggattcgaattctggaatcctgccaagaaatccatcataccttgattgatcgcctccatcgggcttgctaacaaagacatcaccacaccaatgactaaaacaccaatcactggatataagaaaatagccttcaatccatctaattgtttcggtaatcctttcatgactttttgcaagaacagaataaagtacccagctaagaatccagcaaagatcccgcctagaaaaccagcgccaccagcattggccaacaggccgccgacaaatcccaccaccaaaccaggtcgtttagcaatcccttcagcaatgtaagccgctaaaatagggaccatcattcccattgctgtatccccaattccttttaacatcgctgatgtcggattataggtgggatcattaggatcaaaagagtagacaccccagattgcgaatgagacggcgatgatcacgccccctgctacgacaaatggcagcatatgagaaacaccattcatcagatttttataaatactatgtccgattccggcagccattcccccatctgcttgctccaatgcatcgaccgtcttgttttctgcaatcagcgaccctctcaatgcttcttcaattagctgatcggcatctttgattcctttgctgaccggaacattgatcacgcgttttcccgcaaaacgttccgcttggacatctttatctgcagcaataatgaccgcatctgcattttttatctcttctggcgttaactggttttctatccccacttgtccatgagtctctactttaatagctattcctttgcgtttggcggcttgttccaacgcttcttgtgccatataggtatgggcgatcccagtgggacagcccgttgcagcaacaatcttgtaagtggtcattttttattcgctccttcttttgatttcaatttgttcttccaactctgcaacatccgaaaaatcagttagtcccttacgaaaagcggttgaacttccagcagctaatcctttcttcaaattgacatccagcggctcacctgttaaataccctgcaagaaatgttcctaacaacgtgtctccagcacatgctgtattcactactttgcctttaggagagtttccagagtagaccgtatcttttgtcaagagaaggccgccttctcctcctaaagagagcagcacatgttgcgcaccactagccaccaatcgtttggcgtagtcgatatagcctttgcgatcattgatttcggtctgataccatgcttgcagctcttcttcattgggctttaacaagaaaggctgataaggcagacattccaacacctctgaatagcttgaatcaataatcagattcacttgcttttcaaagcaaatacgactgattgctataagaattttgggcgagacaccttgtggcatactcccagatatacagagatagtcaccagcttgcagatgtctaatttgttctagcaaaagattgatctgcttttttgaaatttcaggtcccttattcacaagtttgtactccttattatcgcgatttacatgcgtaaaaacgttgattcgcgtaaatcccggaacgggaataaaatcggtctgaatcgcttgttgatgcaagtagtcctcaatataattaccagtaaaaccagctttgaaccctaatgctgtactatcgataccaagttttttcatgatcaatgagacattgaccccttttccattggcttggatatcatcatcctttgtgcgattcacttgaaatggtttcatctcatctgtttcgataaaaagatcgatcgctagatttaacgtacatgtataaacagccatttgcgcccctcctttcctacaaacctattatggatcactacttgatgtaaatgttttcataaataaacaaaaccgctgaaaacttttacaagaaatacttcatgaccttgaagtaggtgaatctttcgatttacaataaagactagctgaagggaggcagaacatggatacaaaattaagtgagtcagagcaatacctgtgggattttatccaaagtcatatccttgagattccgtcttgctccattataaaattaagtgaatatgcaaacgtttcaacggcgactgttgttcgtaccatgaagaaaaaaggatacgaggggtttactgctttcaagcattcactaaaagaaaaagataataccaatatcaattttgcagcgcttgataaggtggacgaagggataaagacggcgattctaaagaatgaacaagaagtgatccgcacgatcaatatggtggaaagcggcaatatcgaagacgcgatccaacgaatcaaagctgctagacgaatcatgatttttgctcgtggattttctgaactgattgctcaagaaatgatggtcaaatttcagcttactggcaaatactgtgagatgcataccgatcccaacatcattaagaacatcagtaagaaactatcaaaggaagatatcgtgatcttcgtttctttaaatggtgaaaccaaagaattgatcaccgcagctgaaaactgttatgaagcggagatcggtaccattctgctgacagccaatcggcactctagcttaatggcgcatatcgaaattccttttgttggcttcaaatcagaaggctccttctttccagactatgaagttcgttcaagactgcccctctcgatccttgctagaatcttgctcgacgcgtatgcgctgcggactgcagaatcaaagaggcactgatatcttgagaaaatcataaccggtaaggaaactgtagttgatttgagatttttcaaaatgaaatgattcacgctgaacgcattgtttttgcagttattcatatagaattcgatactcgtcaaacgatggggttctttgatttttatccagttaaatttgcttatatttttttgtcaaaaaatgatcatccgaaaaaaatctttcgatttgataaagcggttcgtaaccgtctatctgatcgaaagatttttttgaactgtttgcgtatagaaatgcttcctttatttcgcctcctgattatcgtcggtacgaaacgtcaggcattaggagtcagcaactttactggataacttaactcgaataactaaaacctaaaacttagtagaatgtttcatcgtatgcatgcatttaacccaacaactacgactatcaccagcccgctcttgcttaatccaaatcaattggttgaataaaatcaacctgccatttcccctctttctcagaatagttaaaataccatagttgagaaaaagattgttttcgatgtttctttcctgagaggatctgcttactcacccggtcttccacataatcatagcagctaaaatcaatccgaatggaaaagctatcttcacgtagttgtcgataattctctacttgatgtaggatgactttctttgtatgattttttataccatcctctttattctgttgcaatacttgactgtgttccaacaatagtttgtcagtatagtgtctgctggatttttcaagtgcttcttgatcccaagcggtttggatcgcaaaaaagctcttttggatttcatgaagtaattttttcttttcgttctttttacctgggatttgagcgaataaatcattccttctggttcgttggtctttttttcgtttaactaaagagagaatcgcggctccgcctactgacgccccaaccaaaacataattttctataactgatgatgaaccataggggctataatatccataccctcgtcttccccaagaagctctggaataatgatccgaatagtcatcaactgttgtgacaccgccaaagccgccacgactggtcgaaccaccgccgtgtcccccagcaactgccattccctgcactggcagagcaaataaaaagaataaactaagtaaaaaagccataaagtagtgtttcttcattggataccctcttttgtctgactcagaaagcccgacaattttttcaaaatctttttcatgccattcagttccaagtgttcttcatcttagcactgtttaacgattggcaagctgaataaatgcattttttaatgattcattcgctgtctctttaaaatacagataattgttttgatttccttgattttgttgtgtgattagaacttttggctgcttttgctggaagccaaagaaatagagatgccctccagctggtgtagcatggtcgatgtccgaatagattgccacaatctgaaaatcggcttgtccctcaccattttctgaccactccaccgagacgggcgtttgattaatgacggttgtccatttaccaccaaaaatatcttgaggtacttggagaccatagtaattcgcttgcacatggtcgtcatagcttcgatattgctgccccatttcttgtccccaactctgcataaacgtcgcaagctctgcagacttggaagcatcccacaaaacgtgtgtcaccggttgacttgcttgtgcagtattcgtggaagcttgtggttgtgcgctttgctcatttgacgattgttgttcagatgattcagtggtcctgcttttagacgcttcggtactcgtagcgttagctgttttggttgaaattgattgagacgtgcttgactccgttgtcacgactttttctgtagaagatgtttcctctgttttatttgcggaacagccagccaaaaaaagcagtagacccatcgttgttactagcattttttttcatttattaaaccacccttaaggagtattcagtgtacatatagtagcagaccatatactaaatgcttactaaatttttgcgaagttttctcacaacttcctcatacatgagattgataaataacattacatggcattggtatggatttagaactgcgaaggttacttttaggaccataaaaataaaaaaacagtttagtgtagttgttttgaaaacattgaatcctttgcgcttttcttcgcaagtttgcttaaatatttcaactaatgacaaaatgctcgtttgttccctaagagttgcggttcgccttttttgatgcctttggtcgactagctatttttcccagctttgcaataaaatagtccaaccatcgaatcaagatgattggaccttttgacgcaagttgcctttccaaacaactttgctctcaattttttttgatgtttaatccttaattattttctttaaccaaagaagctccattagtcgcaatcacctgtttgtaccagtaaaagctatcctttttaaaccgatcataggttccgttcccttcatcatccgcatccacatagataaatccatatcgttttgacatttgagaagtcgatgcacttactaagtcaatacatccccacgtagtataacccattacttcaacgccttttctgatggcttcattgaccgctttaaaatggtcttcaaaatactttatgcgataatcatcatgcacttttccatcttcaaacgcatcaaaagcaccaatcccgctctcaacaatgaacagaggcattctataacgatcgtacatgtcgattaatgcaattttcaatcctgttggatctacttgccaaccccaatcacttgtatcaagataaggattcttcacactggtgactaaatttccgccaactttttcccgatcttcttcatcttctgttttaatcatagacatataataactaaaagagacaaaatccactgtgtgttgctgaatgatctcctcatccccttccaccatttcaatggaaaaattgttctcttgccagtaatttttgacaaaagtcggatacgttccaaaaacctgcacatcagaaaaaaagtagttctcccgattatgttgttgggctagcatcacgtccactggatttgaggttaacggataagctaaagctcttgtaaccatgcaccccacctgcgcattaggaatgatttgatgggcatatttagtcgctagggaactagctacaaactgatgatgtagcgcttgataaatggcctcttcagcttctttttttgttttgtacttttcttccaccactcccatcgtagtgaaggggtgtctaaagacgctatcgatttcattgaaagtcagccaatagtttacatactttccgaaatgttcaaagcaagttttgctaaatcgtacaaacatgtcgatcacttctcgggaaacccagccgtcatattcattgactaaatataatggcatttcataatgagacaatgtgactagaggttcaatcccattcttcttcatctctttaaatatgcttacgtaaaaatcgattccagcttgattgggttcactttcaatcccattggggtataatcttgtccatgcaatagatacccttaagcatttcagtcccatttctttaattaatgccaggtcttctttgtaacgatgataaaaatcgattcctcgtcttttcggaaataacttatcgttttttgactgcatggcttcctcgatttgttcaggagacacgtgccattgactgatataatctgtcctatctacatcaggtttgtacattgcgacatctgctaacgacatcccttttccatcaacgttccaagccccttctacttgattcgccgcaattgctccgccccaaagaaagttcttgggaaaatagcttttattcattcgattacctctttcagattgttgtttttatgctattatttctgtttgtatcgtttttttgccagtgaaagtttggatgattttacccttagagtcgataatgtctacctcatcaagatcatccaaattggttactacaaggatcgtggttggatcatagccttcagactggatgccttcaatatccacacttccgattctttgccccttttggatgtcatcgcctgctttaacagctaaatcaaaatagttgccgtttaattcaacggtattgatgccaatatgaatcaatacttctacaccagatgttgactttaatccaatcgcatgttttgtaggaaaaaccagttcgacctttccactaaatggtgctttaattacgccatcagttggtattgcagcaaatccgtcacccatcgttttttctgaaaacactggatcgttgactttttctaactcaatcacttccccatccaatggtaaactgattgtattgacttgaccttctgtttcttcattacttgatgaagattcttctcccagtccaaaagcaaaagttaaaattgctgacaggaagaaagcaagagcgattccgatgaggtaataaacaaaggtatcacccaaaaaggctggtaacgttgttaatgctggaaaaacatagacaatcgcctttgtctgcattgctcccatgaaagctccagcaattccacctgcgattgtttgggcaatcaatggttttttatattttaccgacaagccatagacgatgggttcagttatcccaccaagtaaagctggtacaatcgcagatagcgagagcactttaaacatttttatctttgcttcttaaaaatacgcctaacgccacacctgcacttgcaaaagtggcagccgcaaccattggtcgaataacgtcataaccatagactgcaagattattgatcatgattggcacaacaccccaatgaatgccaatcattaccaagaaagtccatcctgccccaataatcaaaccagccagtaacccactgcggtcactgataaagttcatagcgcttccaatcccatcccctaatgtaacgccgattggtccaacaactaacacagttagcggaaccataataagaagggcaaccattggcaacaaaaaaatttctaaactctttggaatcattcgctttagcagcgtttctaactttgaatagaggtaaatggaaataatcgcaggaatgacagttccagaataccctattaaaattgctggaatacctaagaaatcaaccgtcacaccattttctgtgactaatgctgtgaaattaggctctaaaagtgctgctacaattgctaatgaaataaattgatttgttctaaacactctggccgcactaaaagccaaaaataacggtaagaagaaaaatacactattgccggctgctgaaagaatcttataggtacttccatctgctgacataaaatgataggtcgttaaaaccactaacaaggctttaatcattcctgccccagctaaaggcataataatcggattaaaaatggaagacagtgtattaaagaagcggatgaagatatttccagatcggtcatcatctaatgcttccgactcgtctgatcccaaggcgcttttaatgtcatagttagccatgatcgttttatagacatcttccacttcatttccaataacgacttggtactgattatttgcttcgacgacggacaagacaccggaaatcttcttaatttcatcggtatttttttgtgcaatactttcatcttttaacttgaatctcaatctagtgatacagtgataaagactaatgatattctctgttccaccaacataatcaataatacttttggaaagagcactataatttttccccattgttacaactcctatcaattttgtttatgtttgttataatacatgtgtaatatacaattttttcaacatattaaataaaaatttcgttttttggaaactctttcacagataggagctagtatttatgggacccttaattattagactattgactgttcttaacaatgaaacaacttcttctacctactaccatatcgctcagacacttttgaataactatagcattatcgataaatcaagtatctctgatatagctactttatgcactgtctctaaatcaaccatttcaaaatttgctcgttccatcggatttgaagattattatgaattaaaaaaatcctcaacctttgctgaaaataaataccatttcgacttaaattacatttcaaatattatcaatccaattgaaaaaaatggttatgatgattatttagatgccatcattaaagatattagtgcgttcaaacagcaaagcaacatgagaagtattgatgagttagcaaaatgtctgactacctataataaagtaggtgcttttggactgctattttccgaatcagcagccattgattttcaatacaaattggcttatgcgggaaagtttattattacttatcaaagtgatctcaaacaaatcgaattcatagaacaagccgatgaagagacactattgattattttttctaactctggcggttttttacagcgacaacaacttagagatgatataccctacagaaatgtatttgaaaacacaaaagccaagattttcgtaatcacagcaaatgaagaggttcgtaactatcgtttcgttcatgatgttattcttttccctcatgagactatttttcaaacccattcttttatctatcaaatcattatggatatcatcgttagtaaatatcgacagtatcttgaacctccaacaatctctcacaaacaataataacctacgaatgaaattgacaaaagaactgctagtgatgagaaacctatcactagcagttctttttgaggttttattttttaattaggaagaagtagtcatctaccattattagcaaatatgccggcaatacttttccaatgtatttcttctcaattgcaacttccatctaactattgtctataaggttttctttcttagaaaaatcaattatcagcatttttgttatttaagttatcccgtcatatcattttagtgttgggcttttcttgaaacacttttctaatgattaatatatgcaattgcacttccactaccaaatttaatctccggcaacgatcgtttgtataaattcagctctcttaacgtatcatctctttgagagagtgcacgaaacgcatagcgtgtccgtccgttttcgtttttcttcgatcctgaatattgagaggagactttatatgcagcaacaaccgcattatctgctccagtattaatcgctataatgtagcgaatccgatgaattttatcacgaccaattacccaattacctagcgtacgagattttaaattatgatcatcacgaaatttgtcgtcaatcggatattcatctgactcatctttacaaagttcaaaagcatctctcacttttactgctaagaccaactcatccgttgctatttgatttacagatatgggttgaaatccatatcgctcttctacctcttccactagcattggcttagaaccatgtccttttactaaattcgtcaaagagagtccttgaatcagttgagcataattaatcaacgcattttcactagcgtaagcttcattctcagttaatccatagctaagtatataactcaatggttgcagattcattccgtttatttcttggatagtttttatttttaatgttctagctgattcatcttcttcaaaataatcagattgacttaacatacttagagccgcttgacgatgtgcaaaaatacggttacctttgcctttcccaatataaaaagtctggttgtttctaggatcaaccaaacaataaacatagtaaggatgttgctcatctttttgcaacgcagctaaagtagatgcagaaaaatggttaagttcactcatttgttactcctctgttttactattttttctttcgtggagaaaacaccctcacttatgataaggcgcgcctgtattgatgcgaaaagcacgatagatttgttcgactagaatcagtttcatcaactgatggggataggtcattttgccgaaagagatttgggtgttgctgcgctgcatcacttcttggctgagacctaaggagccgccgattacgaagactagttggcttttgctttggattcctaattgctcgatctgctgggcaaaagcttcactggtgggatttttgccttcaatcgctaatgcaaagacgtattcctggtctttgatctttgccaagattttcttaccttctttttctttcacttgaagcatttcagcttcactcatactttctggagctttttcatcaggaacttccacgaattggattttacaataagcgcctaatcgtttcacgtattcattgatgccttgaatcagatatttctcttttaatttgcctactgtgacgattttaatattcatgaccactcaccttccgctatcattataatggaatttcttttcagaatatatgtcgcgtaccaattttttcttctatagtaccattgataccacgaatcgtttcaagtgactcttttcttactaaaaaaatgattggtagtctaaaaaaagaaatttcattgttttggtctaaatcctccctatcttcttcatatttttttcaaaatctcttagtagactattgtcagaaagaaagaatataataaatacatacaaacaattcaatagggggaataacaaatggtacgaaaaaatgtgacaccaggaagaaaaccttcttccggcttattaaaaaaattaggtattggcattcttggcggagtagttggtggtttgttgaccttcggcggactttatctggcgatgggctcttctttgacttcacctgtaacgaccgcaaccagcggtgttcaagataacaatggacaaacgaaagtctccaatgttaaatatgacgtcaacagcgatgtaacaaaagcagtcgaaaaagtgcaaggagcagtcgtttcgatcatcaacttgcaacaaaataatgcgaatggcctcgaagggttatttggctctggtcagcaaggtggtcaagaatcagggactgagaattcaggcgatgacagttcactagaagcttcttctgaaggaagtggcgtgatttataaagtagatggtgacaaagcgtatatcgttacgaataaccacgtagtagaaggacaagatggtttggaagtcgttctctctgatggcacaaaagtcaaagctgaattagtcggaacagacgcttacactgaccttgctgttttacgcatctcttctgataaagtagacacggttgcttctttcggcgattctgattcactaaaagttggcgaaccagcaattgcgattggttctccattaggatctagctttgcaaattctgtaacgcaagggattgtttcttctctgaatcgtcaagtaacgaatcaaaatgaatctggtgaagcagtcagcatcaatgcgattcaaacagatgcagcgatcaacccaggaaactctggtggtccactgatcaacgttgaaggacaagtgatcggaatcaactctagcaagatcgccagcacttctgaatcaacatcaagtgtcagcgtagaaggaatgggcttcgcgatcccaagtaacgacgttgtcgatattatcaaccaattagaaaaagacggcaaagttgttcgtccagcattgggtattcgaacaatcaacttaagctcaatcacttcgcaacaacaagaacaaatcttgaaagtaccatcttctgtcactgacggagtagtcgtatactcagtaaataacgcgacaccagctgaacaagcaggattgaaacaatacgatgtcatcacgaaaatcgatgataccgacatcagcacaaccacagatctacaatctgcactgtacaagcacaaagtcggtgatacgatcacagtgacgttctaccgcggcaaagaagaaaaaacagccaaagtcgttctatctgtagatacttcgatcaatgaacaatcgactgacagcagcaactaaattcaagtcaaaaaaagatctgccacacaaacaggacgtggcagatcttttttattattttccaactggaaaagcttcaccaacaacggcatcttgtggtaattcaagaattccttttttcaatggtgcatttgctaagtgcagttcacgagcagaacagatcatgccgtagctatcgacgccacgaagcgttcctggccagatcaataacccatccggcatcattgcccctggtttagcaacaacgactttcaatcctttgcgaatattggcagcaccacaaacgatttgcaggacctcgccttctccgacttctgtttccgttacaaataaatgatcactatctggatgtggttcacatgttttgacataacccacaacgattttcggctctaaatcaattgccaattgctccgtaaagccagcttctgtgatcaatcggttcaaagtttccacttgttgtttcgtcaaaactacttgtccgtttccttcaatggcaactgtatcagaaatgtgaaagaagttccaacctacgatcgtaccttcttcatttttgatttgagcgacatttccttttcgtacagccgtttgttcaagccctttatcatctgctgtgatcacgatcaaagtatcgcccacatattctttgttgtatgaaaaaatcacttgtcttcctcctcttacttattccgcccataatcttaacaaatttttgtctgttcgtcatgggaattttctcagtttacaatcgctgcacttcccaatccataaaaaaactgcgacagaaatcagaccaacaggcagctagtgaatgaaaaagcactcgcttgctcttttttcctgtctctgtatcttctgtcacagctttgtcttttgcttattcttcgctaggagagacaaccaacacatcacatttcgcttcgcgaataatataactcgctacactcccggtgataaatcgctcaactgcattcagtccggattggcctaccatgatcaaatcaatcccatatttttctggtaactgtttggccattgcttctttcgcagagccgtaagcaatgatcccttcgatcaaatcaaaattaacggatttaccatattgtttacaggattcgattaattcttgggcagtatccttttcctgctcaatgatcgttgtatctaaaggagcatatcccatcatcgtggggatctgctgatcgatgatattcgctacatagactttcccctgattgcgtcgtgccacttcaactgcttttttgaacgcttcattggcttggtcggagccatcgacacctactaaaatattttgatatctttgcccactcatgtttttcacctcgaaagtttaatttagacttgataagaaagattcgatttctgcttttgtttttcgatctttgttgactaaacgaccaagttctttgccgtcttcgatcactacaagacttggaattccaaagatattccattccacagccacatccatataagcatcacgatcaacttcaacaaattgaaattcagggaaatctgcttcgatctccggcaattgcggtttaatataacggcaatccccacaccagtctgctgtaaaaaagaagacattctttcctttttcgacatatgttgccaattcttctaaattttttggaacaatcacacgctcaccactttcttttctctaatcaaattatacaccttttaaaacagggaaccaactcacaagcaaaagagctgtgaacacgcccatgctagtcactgaaaacagcaccctagttgtcccatttcctgattatcgtaaacagttacaataacagatcaaaaattgaaccaaataggtctgatctagcgttgagtcgtatcacagctcttaatttttattttccttctacaattgtagcaactgttgatttatccaaacctttcaagacttggatcaccatttctctcgcagcatcaaagtcagcgatgctgaatagtgtttgatgggtatggatataacgtcctggtacaccaatcacagaacttggaattccttcattggccatatgagctgcaccagcatccgtaccgcctttagacacaaagtattggtaagggatattgtttgtttctgctgtgtccagcaagaattctttcatccgaggcaacatgatcattcctggatcatagatacgcatcagtgtaccttcacctaaatgcccaaaagtcccattcttcgtcactgtatcatcagctggtgaacagtcaacagcgaagaatagatctggttggaatttcgtgacagaaggttttgaaccacgtaagccaacttcttcttgcacattggcaccagcaatcaatgtatgacccagttgttcttctttcaatgcttccaatgcttctaatacaaccgtacagccataacgattatcccaagcttttgaaataatgtttttgccattcgctgtcttgattgtttctacttgaggtacgatggtgtcacctggtcgtacgccaaaactttccgcttcttctttagaatcaaaaccagcatcgaacagaatgtccgttacttctactgctttttgtccagctgttccacgtagtaaatgtgggggcactgatgaagaaatacatggatagttgcctttcgcagtttttaaagtgaagcgttgtgctgaaacgacataagggttccaaccgccaagaggtgtcactttaaataacccgcgttcggtgatttgtgtcaacatgaatccaacttcgtccatatgagcagctagcatcacgcgtggtgcatctgcatctgaatgatgacgtaatccgaagatcccgccaagtccatcttgttggatttcgtccactaatggagtcatcgcttcccgcatataggcccgaacatcctgttcaaatccactagttccttgcaattctgttaattctttgattcgttgaaacgttttttcttccatacttttttcggcttgaatcgaaacaagccttccctcctcttgcaaatctatatttattataacgcaaattactcattctggttcttttcttatagaaaaattctaaactatggtaaaataatctaaacagacaaaaggatttccgtttattccttaacaggataggagaagtcttcaaggaggcacaacatttatgatcaatgaacgtccattcaattattttaaaaacggcctggccatcggcgtgggtgtcggttttgcaggcgggatcttctcgacattatggatgaagaaaaaacaatcgatgaatgcagatgacgtcctcgatcaaatcaaagcagcatttttaaaagaaggtccgatcgaaggttcctggatcaattttgagaagcaaccccttcgtaaatttgcagtgacatctcaaggatataccggcggtattactcggaccgaagacggacaactgatcacttacgaatttttagcagatgcgaaaacaggaactgttttggatattcaacgatcgatcattgattaatacgcattgctatacaacagacgctcaatgattcaaactcataaaatagtcgaacatcgctagatgatttttcttgtcgttctttatgaacaacagtgatcatcttgagttgtccgactattttttagttgcagcaatctttttgggacgtttatttgcatgaagcaacgttgctaagtctagtaataaaacattggctaacacaggattggctttctcgcgatacgctgcggcgccactttcaaacaatactgctagacgatcttctaaaacaacgatttgttccaaatacggtggaaatttgattcgttttaggatccggctaggagagtcccgctcggacactaagagttccgaggtataaggaccataagaacgactggctaagagataatggccataaaaagccacaccttgaatcttatcagatgtttttctgctcattgtcacggttggttggattttgtctttgcggcgaattgctgttttcatttcagctatcgtcggcaatagatagaaagtcaactgtccttcaccttttagtgtgaagttgccagataccagttgatcattgttttgagtcaaatacgatgcttgtggaatctctaagagatcagttgtcagccaataagcgattggctgtcccgtctcttcagatgtatctgctaagatatcgatcaaacgtaaagcggctactcgtccagtagcagatcctgtgattgtcaaccataaaagttcccgttttgtatcatatactaagccccctacatgtggccgtttaggtaaaatcagcagtttgatcggctgtcctgtttctctatccagtacatgaataatagaatgatgctgatggtcatagcagtaggcagaaataaacacaaaatcttgagaaaaagccaacccttgcggcgtcatccattgacaaacctcattttcgccggtttccggcaccaccattcttgtttctgttaatccaggaatgttatattgttttgcttcagccttttcccaagctgcttgaacaataggataccgttttaactttttttcaatatcctgatgtatccgttgctgcttccaatgcttaaactttaggacatagtaaacaaggaggccaatgaccagcaacactaaaatcattattgctacccgctgagtcatttgtttgcctccttgttctattcgatcaatcgtacatataccgctattaattacagtatctacatgtttcttttactagcgtttctttataggatctttcataatctcatttatagtaacattaagaatcccttattctactatagtcacttccacatcaatattgcctcttgttgctttagagtatgggcaaaatgcgtgggcttcttctgcgattttctctgcttggtccttctcaagtcctggcaaagaaacttctaaaacaaccccgatttggtagcccccatcttctaattgaaataaagatacccgtgctttgacttcagaatcagactcaagattattttcttccagcatgtgttgaaccgcgccgttgaagcaagatgcgtatccagccgcaaatagttgctccggatttgtcccttcactatggattcctgggcggtcgatcttcatgtgcatacttccgtttggtgcctcgacctcgccatcacggcctccacgattgatcattgctgtttcgtacatttttttcattgagatcatcctttctttcgtctttctatattaagtgtaacgagtattttttaatctgacaaaggtaatgcttgcattcgacgacatcagttagacaacatcgatgatcagtgatagaagcagtttgtctatacaaaaaaagaagcagcgaaaagctgctccttaagataataggtaaaattgctgatatatttgacgattaacctcttgaacgtcccaagaaaaatgatactacagcaacaacgatgatcgcaccaatgatagaaggaatcaaagccattcctgctaattgaggaccccagctacctaacaatgcttgtccaattgctgaaccaactaaacctgcaacgatgttagcgatccatcccattgatccacctttatttgtaattgctccggcaatcaaaccgataatagctcctacgattaatacccataaccaatgcataattttctccttctttctgtgaaatatttattacacatattatgttacgcttcttcttaaaaatacacaaaaattttgctcttaaaaaaacaaaaaaaatttaaaacgttgttatattaaggataaatcaacttttttggaatcgttaacactcactgcaagaggtcaaaaaaactgccgcagctctttgaaatcgttttgatcagcaaaaagttattttctgataaagggtacctagactatgtacgattttctttcattgtctgctttcaaccgtcatcttccctatgaataaaagcaatcaaagaaaccagattgtcgtacacacctcattcactacatccttctgatgaaacatcaaaacaattggcattcctttgattctgccttttgtatttgaaacctgcttcccctcactatgtaaaaggattatgagaaaaagcagcgatagaagtgagcgtatgcaatagcgagtaaagtaaaaaataaattgttcggattgtaccccggcctttcttcttaatatttttcatttctcgcttctcccctctgcttattggacagtcttcgcgattgtgaagtcacgaaaaaaagcaactttgcccagcgttcaatgctagacaaagttgcttttttattttgtttttgaaaagtctttctttgaaagatagacagcagtaaggatgcctactaagacagctaacccaaagactagaatcgttcctatcgtgttatccttcccaggcagtccgccagtgttgatcccccaaagtccagcaattaatgatggcactgcaaccactaatgctgctgaatctaaatatttcatcaaatggttcaaattattgtccatcatatccgagaatagaccaccgatggtttccaataaatcgcgatagatcgtgacaagcttgttggcaaatttctgtcgcagtttaatgtcgtaaactaacgattcattatctagtttgtctaaaaactcttttcgttccatcaagtgattcactgtaagattctgatctttcaatgtgtgatccaaataaaccatatctcgttctgtgtctgccagattaaatagttcattattttcggttgttttacgggcagccgcatccaattggtcgatttgctttttaatctctttcaacccattgataaagtgggtatagatcattaatgtggcaaaagcaatgatatcctcaaaatgtcgaagctcatttccatgtttctcgatcaatcgctcaacgagattcgattctctagagacataggtgatcatcaatcctttggaaagaataaatgtgacaggttcaaggcgtttttcaatgcgttcttgatgatttgaagaaagatcgatcaatgtataaagaaacggattgtttaatttagtgtctcgtaaatgttctaatcgagaaacttcctctggttcatcggagccaataaaaatatcttccggtaaatcaaaaagtgtcagcagctcttttttttcttcttcatttccatgtttgactaccaaccaattatagtcttcttcggatgattctctgatttggttctgttcgattttatagtacgaatacattttgcctctctcctttaactccttcacttctcttcaactatctaatggcgactgctttttgtcaagaaaaagcgctatttcaacggtttttattaatacggaaataaagcaagcgtttgattagaccattctaaataaacgtgagagaatatttttgggcccaataaaaatcattttagaggaggacaactatatttctacatcagaaagaactacagttcgaagcaaaaccagacaaaccaaatccattaattgcgaagtatcttcaagaattgatcggtggccagtatggcgaaatgagtgtagcaatgcagtatctcttccaaggttggagctgccgtggagaagaaaagtacaaagatatgttgatggacattgcgacagaagaaattggacacgttgaaatgcttgctacaatggttgctcgtttattagaaggtgcaccggtagaagatcaagaagccgcaatgaaaaaagacccagcaattggcgcaattatctctggaatgaatccacaacatgcgatcgttgctggcttaggaccacgtccagctgacagtgtcggtaatccatggagtggcgcttacatcattgccagcggtaatttactggcagacttccgtgccaatttaaatgcagaatcacaaggacgattacaagtcgctcgaatctatgaaatgattgatgaccgtggagttaaagacctcttatccgtgctattagctcgggacagctatcaccaaaacctttgggcacaagctgtcaaagaacttgaagaaaaagagggtacaatcttagtaccgagcactttccctcgtaatgaagaacggttagacatcgcctatgacttttacaatttctctgaaggagatcaaagtaaagaaggctcttgggcaaaaggaaaagcacttgatggcgaaggtgaataccaatggctttctacacctaaagttgaaggcaaagcgccaaaactagatcctgtcacaccaaaaatgtatggcacgccacctgaaaaataaattgatcgaaacgaataaaaagagcaatgattccattcacaagaaatcattgctcttttcttgtcttattgagcaagttggttaccttaaagctaaaaaagcgttagagtagaatgtataagaaaaaggaggaatcattatatgaaagcacctttacttacactaaatgacggcaatatgcgcccagccgtgggcatcggtacctatcaaattcgcggtggcgaaggcttaagccagttgcaagcagcgattgcagatggctatcgtttgattgattcgtcaacgaactatgacaatgaaggaatcgtcggtaaagcgattcgccgatccggtgtccctcgttctgagttttatatcacctcaaaattaccaggaaaatatcatggatatgatgatgcactgaccagtattcaagaatcgctggcgcgcatgggattagattactttgacgcctttttgatccactggccactgcctaaacgcggcaagtacattgaagcgtggcaggcgttagtgactgcgcaaaaattaggtttgattcgttctattggtgtatctaactttgaacctgaacatttagatgccattattgaggcaactggtgtcactccagccatcaatcaaatcgagatccatccttactgggtccaagaacaaatggtagcagaaaacagaaaacgtgggatcattactgaagcatggagtccattaggccgcggcagcgcggcgctcaaagaatccatcatcactgatctaacaaataaatatcaaaaatctgcgggtcaagtcatcttacgctggcacgtcgatcgcgggattctaccactaccaaaatcccgaaacctgagccatcagcgagaaaacttagctatttttgactttgaactgactgaagaagaaatcaatgcaatcaatcgcttgaacaaagaagatggacgtattgaaggtcaagatccgaatgaatatgaagaatttgagtaaagtgagacagcacaaagctcctgagggatttcataggctcacatcaattataggaattggaatggtcacaaaaaaagaactgcgagatgacttgccccaattgaattccttagatctactagcagcaaggctctactgaagtcttgctgctattttatgagaagtaaaaacttctgacacgatcagttttcatttggattatgcttttctcacagttctttttctgagttaaaacttctgtacaatcagcgttacaactgataatgaatggcttctttgtattgttcaaacaatgattggttcaattcatcgccgccatccatatttgcggaataaaagatgggcggataatcgattcctgcttgtttcaattgttggcaaacttcgacgataatggtattaaggatcgtagcgccaatcaccgttgaagtaggccccactttttgatccatccccttaatctgacaacctgcatcaccaatttctccatgattatcgattacaagatcagcgacttcaaacagacgaaggcccgaagaatggcggctagtgactgattgcgaatacgttttgtttgttaaagcgataattttgacgcctttttcttttgccgctagtgctaaatcgattatgacaggattacgacctgaaactgagtgtaaaatcagcacgtctccttctttgaacggctggatttccgctaatgcggtgccgtagccttctagtcgttccattttgctagtaaaggtgatgggactgcgatccaacatcagttctcgtccaaagatcgcattgatcgtcatcatccctcccgcgcgatagtacatttcttctgccaagatccccgcatgactagccccaaaaatataaattgaatgcttttctagatttgctgtagtcaagagacgaattgcctcatcgattgcatgctgttcctttttttcaacggtttctagtaatgcatgaattttatcaacatattgatacatattaaattcccccaaatagactgccgagaccacgaccaatgattccccaaagtgataagtcattgccaccaaagatcagaatccagttttgaatcgttgtgctgaatagaacggcagatacaccaactaacaagaccatcacaaatgatgcggcaatggtaccaatgactgcgccacgcaagccgccttgtccttctccaataactgctgcgccgccacattcaaagaaactggtgataactaatggtacgatcaagattccaaaaacattcgtcgtattgacaatgatcacaaggatcgttgaggtgatcatagctacgataaaaccaataatcacggcattcggacgataattgaataggatcggtacatcaaaagctggtttggctccagggacgactttttcagcaatcccttggaaagctggaataatttggttgatcaataggcggaccccataaagcatgatcaagagtcctgcgccaaagttcaagcctgcttgaacagcaaacatgaccagattcccaccttctgggacaagaactggtgcgataattcctacaacaatattcatcaaaaacatcaccaaggcacctgtaatggaaatctcacggaaaaaggacaggttttctggcacttttaaatcttctgtcgatttttctttgtttcctactcgttttgccacgaagccggacaccatcgataagatccctgtaggatgtccaatcaagaacgaatcatcgccagtggcatcccaaacatatttccgcatgatccaaggcataaatgaccaataacaagcagataaaacagctcctaaaatcaataatggaatccccgacattccaccttcaaccccaccagcaacgatcacaaatgggaaccaccataacatatgacccgtcaagaaaatcgttttaactggtgtaaaacgagcaatcaataagtgcaagatcaatccaaaaaacatagctaacccaacagttcccccgtattctgctgtgaaggtcacatcagaaagaccatcggctacttgaacccccaactgtgtctgaaccgctgtgttgattggtgcgatcgttcccgtcagcatattgacccctgcggtcaatgctaccatcccaaaggctgctgtcaacgagcctttcaccacttcggcaaaaggttttcgttgcacgatcaacccgatcattgcaatcagtccgagcaatactggcggattctttaaaatatgatctgtgacaaaactcatgattatccctctctttcagctaaaaacttttccatttgcattttgacttcagcgacatccatatattttttgatgggatagacaggtgctttgacggaagcttgcaaatcattcaataattcgtggcttgtaaaataaacatctgcaggagttgcttttgcagtagacaaatccgtattctcagcagtcgccttcagccccagctccttaatcaccttatcgatcgtcatctttaacaccattgaacttccaacaccaaatccacacacagctaaaattttcatcttcttttcctcctattggaataattggcaaatctgttctttgtcaccattcaaaataagttgatacttttcctgatccataaacacttccatgatttcctgcaaactttccaaatgactttgattgtcttttgcagctaaaacaaggaaaatacggaccgacttgccagctaaatcgatttcgtttttagtcactagcaaactcatcccttgatgaaagacaccttcccccggacgagcatgcatcaatgcaaagtaatcagccaataccatatacgggccattctcctcaacgctatggatcatattagcgacatattgttgatcgatggctttttcatttaatagcggctgactcgccaattgaactgcttcttgccaagtgaggatttgattcgtggtctcgatatgatcctcaggcagtaatttttttaaattgatcatgattttacctccaacatttttgaaatgaaccattctttgtcttcgatcccttgcatgatcaacttcatgacaggttctacttcttgggcctcatcttctcgtatcattagtaacacgatgatatcgactttttggttgccccaatcaacaggacgatccaaaatcaatacagaaaaggtcgtttttgaaacaaactcaggattgccatgaggtatggcaaaaccgttatctaaataggtcgactgcaatgcttctcgttctaagacggaacgctgaaagtccgtacgctgattttccgacgaaaagtcattttgactgatcagaaaatccagtgcttgttctttggtctcaaatcgttcaaaataaatcttcggtgcaatcaacatccgtgtatcttgcaggattttcaccttatccgcaatcggttcattatcaataatcaaatcgatatagtgattcatgatccgcttcatgtctcgattggtcaccatcggcgagatgcggacgactggtttggaaacatcaggtaaatcgatcgtggaaataatgaaatcgatggcagaaatatccatctctttgagcttagcgacagaagcggtttcaatactatcgacattaggcaatattcgacgaatctttgcagaaataaatgaactggtgccaacaccgttcggacaaacaaagacgattttattcaattgccgcatccgttctactgcagcttgaaagtgaatcgaaacaaacccgatttcatcctcagatattccaatatggtaggcctttagaaagtcgttcaaagagaaccaaacgaccccatacaacgccggataatgctgtttgatctcatctagcaatggattgactacagtagtttgggcctcaatgcgtaaaaacagctggtacaaatgaatcgtcaaatcttcttctaagcgactatcctgtgtcaaatcgatctggatgccttcactgactttctgaatcagatttctgactttccctcgaaaagagaacggaatcgattcgttcttcataaaaaaacgtaagccactacctacaatgagataggttaggtactgaacttctttcgatgaaaaatggtagatttcttgttcttcaatttctttcaacaattcataaatcaacggatacttgtcaaattccaaaaacaattttccaaattggcgcttctcttctatatccagctgatttgcctggttcgagcgctcgacaatcagcaagatcgaaacaacgatgctttggatgtagctttctgggatctccatttgcttttcggtgatcgaatggcgaaaagccgcatttatcttttcaaataatgacacatttgtcagaacagaaagattctccccatgctccatagtaaggagaatgaatcgcttcaacattcgttggatttgtgactcgcttccttgaaaataagtgcctgaattatcaaaacgcaacagtaaattttctttgacaaacagtgtttttagataagcgatatccttggcgatactgctcctagaaacataatactcatcagaaagttgctggtaactcaagtgctccccattgatcagccgcttaaaaatttgcatgcgtcggtcttcgatcaaagaataattgtttttcatttgctcaccctctacctttattctagtgataccttaacaaatatgaagaccaattgttagattaaaaaatgattaaaaggtgtgcacaccctttcccttgatagcaatatcggtcgtttgttccgcaaaatcgcttcaagcaagccaaacttttctcatcttcctcgttttctcttataataaatgtaaacagtcaaatgaggaggaaacaaaatgaaatggcgtgggggtagacaaagttccaatgtggaagaccgctctggtcgttccgcaggttcaggaggaaaaataatggccggcggtggtatcggtacgattgttatcgcagtcctcttttttctattcagtgggggtgatttaaactccgtcacagatattttaggaggcggacaagccgctaattatcaaacagaaaatgtggcttcagacgagtatacagaggaaaaagaattctccgctgtcgtcttcggccatttggaagattattggaatggtgtttttgaagcagaacagactacgtatcaagatcctaaactggttttatttacaggaagtgttcaatcggcttgtgggaatgcaacttctcaagttggtcccttttattgccctgccgatcaaaatgtttatctggatctcagctttgcaacagaactttctcaaaagtatggggccagcggagattttgccatggcctatgtcattgctcatgaagttggtcatcacgtacaaaacgaacttggtattacacagcaactcgataagatccgccaacaggtttctgaaaaagaatacaatcaatatagtgttcgtttggaactacaagcggattatttagccggtacatttgccaagtatctacaaggaaaaacttataacggccaaccgattttagaagctggtgatatcgaagaggctatcacagctgctaatgccattggtgatgatacgttacaaaaggaataccaaggatatgtcgtaccagatagttttactcatgggacttcaaaacaacgagttgaatggttcaaccgggggttcaaatatggtgatttggagcatggagacaccttcaatgaaaaaaaccttgatttggtctacggatcgtaacaaaaacgttcctttttagtcactcttttttcacatttgggcggtatagtttattcataccaacaaaccctaactttttcattttactccttgcctgccagtccccgctggcaggcccttttttttcatggtgctattttagtttttttttaacctttggcctgtttttttctttaaaacgctaagggttgatcacaattttttcatattttccggttactatataaataacccaacaaacaacccaactttttcattttttactccttgtctgtcagtccccgctgacagacttattttttttcttgccaaaattctcaaaatgcgctaaggttatttatgcgcggaagtggcggaatggcagacgcgcacgcttcaggcgcgtgtgagtatatctcgtgtgggttcaactcccatcttccgcattttgagcagatcatcttggatgatctgctcttttttatgtgtttcttttgtctaaataaagaaaaaagcttaagctagaagtatatcaataggaaaaagacaggaggaaatccaatgaaagaagtaccaacagcgaaaatcaaattaactgaggtcaaagaactctttgatgctggttatgaaatcttaggagaattacggtctgaggtgaatgccccagtcgttagagctaaatttctgaatcaagaagtgattgccatttatggaaaagaagcagcaaaaattttttatgatccacgaaactttaaacgtgaaggagcaatgcctaaactcgtccgttcaaccttgttaggggaagagggggttcaaactttagacggggaacaacatcaccatcggaaaaactactttatggacttgatgacacctgagagaatgaccgattaccatgatttgttggaacgaaacctttctcatgaactggataaacaatccggtacctttgagcttttttcactcacaaaaaatgttctattcaaaacgatttgtgaatggtcaggaatcaatctagcaccactgtctcaatcagagatcagtgagttagctgattatcaagttgctatgttcagcgggactgtcacctcccctgtcgcccatttaagaggcgtcgaagatcgtaaaaaatctgagaaatgggctcaaggattgattgaagaagctcgtcaacatcctgttgctggcaaagaatcattagcactttatactttcgctactgccactgatcttgaaggtaatttactgccgatcgaagttgcagccgtcgatctgttaaatatcatccgccctacggttgctttaaccgtttggatcgctttgatgggacatgccctttttagtacaacgactatctaccaagcacttaaacaaaacttttcggagttacaggattcatttattcaagaattacgccgcttttatcctttctttccaatgatgcctgccattagcttgcaagatgttgtcgtcgatggttatctgatccctaaggacagctgggtcgtccaagatatttatggtacgaatcatgatccgagaacctttgatcagccagatgacttcaaagtggatcgctttgtcggacgtacacaagccatttcctatgaggaagaatatgaaatgatcgcacaaggaggcggtgatttccgcaaaatgcaccgctgtgctggtgaatggattaccttgcatacgttgcgcgtgttcagtgatttactggtcaaccactatcagtttgaagttcctgaacaagattggaagattccaatgaatcactttccaacctatccagaaagtaaagttctcttatttaaagaagctgcaatgaccacagaaaatgagtaactactgatcgttgttattaagtgcagctcacaaaaacgcagcccaagcaagcttagggctgcgttttttgcttacttctctacagatgccgtacggaaataaaaataggcaccgtatgcgggaaattggatatctttgatcgttgacctgatcatataatttgatgcactctgatatagaggaacttgagctgcatcttctgctaacagaattgattctgctgatttgtaatcttcaaatactttatctggatcattggcatccacggtacgtgcgttttctgtcaatgccgtatagtcctcgttgacatatccaccgtaattgtaagaagaaccttttttatataaattgaaataagagtccaagtcattgctgccagcaatccaaccagaaatcgacaactcatattgaccatctgctcgtgattgattcaaattcgttcgtggttgtttattgattgtaatcgtcaaaccaggcaaatgatcttgaagctgattttgcagatattcaccgattttttgtccatgatcatcatctgttaccaataaagtcagttcaattttgtcaccgatagctgattgtgcttggctccattctgcttgtgctttgttactatcgtattcattgtattccccgctataagtgcgaaaatcttcattggtattcggattggcataaagcccactgggaataaggccattcaatacgcttgctccatcgttcaacacatcattcacgagactctctttgtcaatcgccaaagcgatggctttacgaaggtggacatttgccaatggtttatttgcctgtttattaaaatctaaaaaatagttggcaatatccttttgagtgactaaggagtcattattttggtactgttgcacatagagtccgctgattttttgcagatccaactccccgctttcaaacaactggattccagtattctcctctttgatcgtggaacctttgattttatccaacttaactaccgcttgatcgtaatactcaggatttttggcaagcgtccattctgcaccggtctgttgccagtctttcagaatgaaaggtcccgtatagagcaagtcttcacttgttttcccatatgccgtccctttttcttcaacataagactgtctttgaggcgctaaccagccaatcgacaccaccgataaaaaagaaggttgcggctgttccaaatggacgacaaaggtcttttcatccggtgtttctaagccaatcgtcgcaatgtctgctttcccttcgcgaatatcttgactgttgacgacattgtctaaaagatacgcatttggccccatggttttaggatcgaccagtttcttccaagcataagcaaaatctgctgcttgcacttgctgcccatcactccatttggcttcttcctttagtttaaaggtatatgtcttgccatcttcactgatgactgcatcctccgccaaaccgggaactggctgactcttttcatcaaaacgatacaagccttcaaaaagatgctggataacggtaaacgtaactttatccgttgtttgcgtcgtatctaatgttgtcaactctgccggtaagctgactgaaatctcttgaacttctggatctgtctcctttgcggacgatccagtcgtgctacatcctgctaacaaaaaacttaaaatccctacaacaaccaaaccctttttcatttactctcctctttccttttcacttgcgagttgcaagcttgattaaataaaaaaatcctcgtccctttgctgatcatcattgatcaacaaagggacgaagacttcgtgttaccaccctttttcgtgtcatttttacaaataacacctcatcagtacgtatgcatactcggcaggataacggctgcgttccgtctaaccagcgtaaaccagttaaaagactctgagctcatcttcacttagcgttctgtcccctttctcaccaacccgggttctctttaaacagtcatcaaagctactcttctcatcgatgtcctatattctactgaattgataaaagtatactattcctcgtttttcaagtcaaacagtttttagaattttcaatcttttcaataatggcttcaagactttttggagggcaaatacttgccagcttagtgttttttttctaggataaagaaaagaaaccttgctcgaaaggatgaaatcaatgaaacttgctgaagcattattactacgaagagatcttgaatccaaactcactctgttacgagaagagattgccagtagtgccgtgatccaagaaggcgatacgttagaccgcagcatcgacgacttactgctggattatgaaacaacaaaccaagaatttgcccagttggtcattgcaatcaatcagcgaaatgcggtcgccaaaatcggtggacaagaaacgattgctgccgcattagagaaacgggaagctttaaggcgttcgcatgcgatgctaacggcaacattggaagcagccaaggttgctccacggatgggacgtaatgagattcgtatgatccgaacgatcgataccaagcaaatcaccgaccgtttgaatcaaaccgcaaaagccttacgtgaattagacgggcagattcaacaaacaaattggcttgttgatttataaaacagctgggtgggagtcaaaagcgagcacaaagcaggtacaggcttatatgtacaccaatggggtctggcagggaccagtttaatgactgctgttcagttacaagcgtacaacttatatttttcaattaacgaccacgtgctggtttgacaaggtgggtgcctctgtttatcttttgttacgcaaaaggtaaacagaggttttttgttcagcaagacctctttcaaaagaaaaagaccccctgatccgtttccaacataggaaaccagatcaaggaatctttgatcgtttagctagttactttcttttctgtctgcgatataccactactacaatgcctactagtaacaagcctactaacatccagctgacttgatacgtttcaccggtttttggcagttcgtttttcttcgtcggtgtttttgtattctgattttttgctggatcaggagctttttctggcgtgtagcggttagtaaaggttggctcgctaccataatctgctttcgcttccaatgttccgttttgatctttgacatttacggtcactggaatctctgcgtcatcataagtgattgtactgtcttgtccggctttttcccggatcgtatagttgtactcaccggctttgtcgtacggaatcgcatcgaagtaaactttccctgtgccgtcgttggtttggctttgaatcacttgtccctcttgatcgactaattcaaaggtgaactcccctgcgactagtgaacggccagtcaaaactttctcagcttccaacactacactgccggcttttggtgtgtaagtgttcgtgaagacggcgttgccttcataagtcgctgttgcttctaactgtccgtcgttatttttcacctctactgtaacattggtgattgaatcatcatagctaatcgtagcgtcatgtccttgtacttcataaattttatatcgataggttccttctttttgataagtaatctcatcaaaaagaatattatttgccttgttcgtcttttcttgaaggattttattttcttcatctgccaaaacaaaagtgaattccccgtcttcgatctgtcggccttccaaagctttcgtagccgttaaagctaggctagtttcgataatttcccttgtattagctagttcaaagacataatcgacttcctcgttcgagatcgtaaacgtatattctttttcatcccgctcatatccatctggtgctttcgtttcttggattttataatctccatatcgtagcccatctaagtggtcaaattcgctagttccttgaatcaacttattatttctgacaacaagttcggagaaaacaacttcgtagtttccttcggcatttttacgactgagttggaaatgtgcctctttgttgatcccagcttccttatccccttctctgtcatatttattgattgtcaacgagccatttgttcccgttgaagtaccgctaccgttggtagatttgacgattacgtcttttgttacttgatggatttccgtctgacttccgtaaagagacacatcatttgaaacaacttcattatttcgaatgccaggatcaagtttcgtttgataaacgatgaagtatggactgtcaatgacatcctcaaaagcaatacgtaatgtgaatgttccatcaataccattcgttgttacatttggattgtcttgattattgaaaataactttctcaccttttatccattgatctccgtctttgacggctttatacacatcaacaaggacttttcctgtctcatcgtacaagaaagtctgttgattataattgatcgtatcttcaatcacagcattcttgatcgttcgactatcttggttaaccagcacttcccaatccaacagtcgattattgtcaacattttgagtgccattttttgttaaccagtttccttttgcggatttctcaacttacgcttcagcagttaaatccgttgtaccatctgtcaaagagatcatattattgtacttgtaaacatctgtagctgcttcgacagcaatgaagacagcaatcgtttctgaagtgtctttcaacagttctactgtcacttgttttgtcactggatcatacgtcaagcgataatcagctgagctcaattcttccttcagagatcttacttggtttcctgttccggatacgtcaactgtataaactactgcttctttaaacgtttgaccatcttgtaattgatcgacaatcttggttccttcatgaagtgtcgctttatacgtattaaataatcccatccaatagatttgatcacttgtagcaacatcttctgaaaagatatttgggaaattacggttaaaagctgcttgcaagtatgcttttacatctcctccttttggaatgaaaagccctgcttttagcgcgtttaaggtccaagtagtgtccatccatgaatttgcttgagcggcttccctataagagttaccgtcaatttcataatcgacaaaagcagaattactaaaacgtgttttggcacttcctaaagcgatctgtgtcgtcatatcaaaagtcgttttgaatctgaccgtaattttgtctgctgtctttgcatagtttccttttagtttaatttgaaaaccagattcgtactcaattggattttctccagaagtggtttcacgctgcttcgataaatcaaagtcgcttgaagtcaattctttaacttctcctgactggctagttgcagttaaaacaagagagtcttcaatcaattctaatccactaatatttgtcccgctaatttctcgatagcgatctgtgatgaccatattttccacttctacatattgctgatttatctcaatctgccattgaatcgtttgatcctgataactttttgatggtgctgtttttgtcacaccaattttgcttgttggggtcactgttcccgacccattatgagaagttgtcgtatcatctttgatagttatatagttagtaattctagtattcgccagtactggatcaaagagttgtgtctcataacgaatcacatattgtccagcatgagcgaacacaagttgaaattgaacaagctgattatctttttttatttctcctgcttcatcaaagtgccaatctgtcacaatactgttatcatttttgtttctgaccactacagaatcggctactaaataatgcaatgcattttctgaaagtgatccagaatacgttttatcaatgagaattgaaccgtctttgctaagatctaaagaaacctcccaagaagcacgaccagttgactgatcataacctaaaaatcgcttatattccgcagattcatcatagctgactgttgcttcaactgatttttcatggaaattatctccagtgatttgagcaacatttttgaaggagttaatcgttggatcattgacaacactataaatttcaattttgactggcttatcgattttttgattgaatgtaaaagttccagtcgttgagttataagtatacaagtcgctagttctaacccaagcgtctccatcataaaggtaaccataagaatgagaatatgccaatccgcttggtagtttatctgtcacaacgacgttttctagttccttgctttccgtattatatacgatctcccaaacaattgagccactagtacttactttcccactcttcgtaatatcgatttgatagattggtaaagtaatcaggatctcattgccatcacggtcataaataccagtttcgatgacaacatcttctgtgattgttgacactttcaattcggtttcaagattgattgtcccacttctacctgatagattctctgcgttttcattgaaaacaatctttaattctccatttgcatttagataaaagtctcctaatgatcctccacctgaacgctgtaatgtgcctgacacctcattgtgaacagcaaaatagcttggtagctgataaatataataatcaccgtttttgatttcctcctgatcagataatgaccagtcaaagtgaatcttaatattgtcgttataataaggaggattgttttgatcaaaaggttgatcattcatatctgtaattcgtacattatcaaatagttgaattcctcgagcatttaaatctggattaacagcatttggagtgactgcttgttcggtagattcagtctctgaatcctccgtgggtgcacttggctgtattgtattttgattcaactctgaagtggacgtttcagtcgtagtagtagtggtcgctttttccggttgactgtttgaggtatcttcgactgtttgactagtactctccgcgttttctgaagttgttgttgattcttccgtttttgtgtctgtcgcaggtgaattcgattgactcgtttgactttcaacttctatatttgaaaccatttcagctactgcaattgccggtgtacaaaaagtcgcacctagcaaaaccaacaagctcaaatatgcacatagttttttattcatagtgattcatcctttctaaaaaaacaactgttactttttagaaaaacttaatttttttacttttctaaaatataagtttttctaaaagaaccaaccaatataattatttatgatggcaccgtactgtacgttcttccctcattcttccgaagacagcataacgattgatatagctagaccagaacctatttttcattcaataacataccttttttatagaaaatcagagacaagtatcaataaaaaagcatgtgttatctcacctttattttcccaaatttggcataaactaagtgttcaaaaaaaatcatttttcaaatatttttgactatttggaaaaacgtgctaccatcaatacataactgattggaggaaagctatgttcagaggtttattgtcaactgcttcacaaataaaattgtagttgattgaaagtttgttgcatgaccgtcactgttttattgctgatttgctggatgaatttgacctgtctttgtcgttgttcagaaagtatgtgacagagatcaatcacgatctgtcctttcttcaaataaatatagacaatcattcctaagtgagtctggaattccattctttcgcttcacgatcggatgtctatagttttttcttggctgactcttctgctttcaaactcttggaacttctgttttcatcccacttttccagttatgagacactagcgattgaattgaatctaagcaaatcctcaattattcgtttaattaaaaaaatcaacacggtcatacgtccttttgattttcatatagaaaaaaaacctatccgcatagccgggaatgaaatgactattcgccagttttacatggttttctttttggagaaataccaacatgagtttagagatgccagtaaaaatcaggaacaagaatttttaaaagttgcacaacttttggctgaagttactccattaaagctgtatttttctgacatacgaaaaatagcgtttatcatttatgtacatagtaaacgagagaggctttttgccacggaagtgcaatcgaataaaattgaatattttctagaaaaaatcgatctcgctgaattctctcgctacaaacgatcttatttagaaaaagttatgggttatctgacttctcatatcacagccgacccagctatctataaacaagtaaaaaaaatcttctatcgattgactaaacaaatttttcttaaataccattacaccgaaacagactttcaagaaaaattggatgctgttagtttcaaatatttgctggaaacgaatttgaatgttccgtattgtattttgaatgatcgcctggcccattttgttgataactgcgatcctgtccagcaagcaatcaacaaggatattgttcagctagtgactcattctgaattaccggcgattcgccctgctacgatcaaccatttgatttatattttccatacttcttttccactatttacaaaacaaatcattgatcaacatgcagattatcatctcgccttgttctacgataccaatagcgaccatacggaaatgatccgaacacaaatcaaacagttcgtcccctacgacctgaaaatcacgattctcaatccgttagactctttttcaatccctgccgtcaaagcaacctatgatttgattatcggaaatatcgtccctccttttcagaaagttcctttcaaagcaacagacatctttattacacgaaatgagattggctatatcgcaaacagtattcaagaaaaagcgatccagcagattgagaaacaaaaagaacctcttagccctactcactgaaaaagtgagtttcgctaaagaggttctttttaattttgtcgttcgagtaattgtttgccttgagcactctgataaaacgtttcaattaaatgatttaaatttgtttttgtctcactggcgccaaaaagttcaccgccaggttctagcataagaccattggctagacgaccgatcactaccggatcaaagccaaagtcgtcaacgattttggccgtttgagacatagattccggatcattaccagcgattgccatggcttttctggctggtgaaccagccggccgagcttcgtcttgaacatcatgataacccatatggttgaatgccttgataactctgctttggtcaaaatatttttggaccctttctgaagatgtttcttcaacagtcgaatacgttttgctggttccatcaacttcccaccaatagttcattgcatcgatcacaagtttaccagccagctgctccttgggaagtgacggatagttgcttaaagggattgctaataaaatgactggcatttccgtcaggatgtctgagacattcttcacctttgcacctggagcaaggatttcaacagctagagcattcttttccgctggctttctgctagcgatccagacctcatacccagcttctgctcctaattttgctaatgctaaccccaacttgccggctcctaagatgccaattctagattttcccattatttcccacctgatttcaagagttctttgaccctagggattacttttgtaccataaagttcgatagtccgcagacggtctttttgtaattgtccaccggttccataaacaagatcaaaccgttcgacgccgacttgcggcatcgttcgcgcaattttttgtgccacagtctcaggactacctacatagtaagagccatgttctacttcaaaatcgaaacgttctttcgacatctcgggccaaccacggtcttctccgattttatccatacttttcttgatatagtgccaaccgatttcgtacgcttcctcatccgtctccgcaatcaccccatgggaatgcatccctaccggaagaatcggtctgcccatttgctgcgttgctttttgataaagttgtacatagggggcaaatcgcgcaggctccccgccaatgatggctagcataactggaaagccgtagcgaacagcacgaataatcgactccggtgttcctcccacgccaatatacgtatccagtgttccttcgagttttggataaacttcggcattctccaaagattgagtaaatttgcctttccaggtcagtggctcccctttaaggagttcgtaaaacattgctactttttcttcaaataattcttcataatcttgcagatcatagccaaacagtggaaaagattcagtgaatgaccctcttcctaacatgatctgcgcacgaccatttgaaagggcatcaactgtcgcaaatcgttcatagacccgaactggatcatcagaacttaatacagttactcccgttcctaatttgattcttttagtgaccattgccagcgcagctaatactgtatctgggcttgagattgcatactcttcgcgatggtgttcgcctaatgcgaggatatcgacaccgacttcatcggccaactttccttctgcaataatatttcttaatgattggctgtaactgattcgttgatgggtctggtcatcaaaggcaagatcgccaaaggtatctaacccaaattctatttgtttattattgattgtcatatcatttccctcttttcaaatacttcctgcattcactataacaacttctttttattaacgcgaaagatatgcttactttttgtaagtcaactgtttatgaattgcttcaaaaagaaaagcgcgtccttgcttcaaacaaggacgcgcacttttttgtttttttattagccatcagagatagattcctttgcttcttaaattagctaaacactcctctaaatacattgcagtatgttcaggataaatagggactgattgctcaatcggctctaacacctgataaggagctgtcttttgcccccgataagtaggctctaaccacgctgctgctggacgatagccgcgacgctgcatctctgccatgacaaggagatggtattggtacagcttatatggagaatgagcaaaaacgtaatcgactgtcgcatgtttctttccccagccagcgcctctcagcgcagctacttcccgatgctgtcccagtaattgttgtcttggtaatttaggcaaaagtgcttcatgccacaatctcatatcctcagttcctctgcttcgcttgatttatgtctgtaatttattggttgtcgagcacgattttccctaccgcatggtgtgtttcacttaatgcatgggcatcatagacaccttgacgagtcaatgggaaagtttcgccaatcacacttactaatttgccatcagccattagtttagctaattcgcttaactgttctccatttgtacgtaaccaaattgcttttgcttcaatttgtttcgttgcggctaatgtttcatcttcaatactcagtacagaaatcaagcggccatgctcttttagaacggagaagcttttcttttggatctcgccacccattgtatcaaaaactaaatcaatgtcagtaagaacttcttcgaaatccgttgtatggtagtcgatcacttcatctgcacctaattttttaacaagttcatgattacggggacttgccgtcgtgatgacataggcgccggcatttttcgcaagttgaatggcgtaggtcccaactccgccagctccggcatgaatcaacactttttcgccagcttttaacgaaccatgatcaaatagagcttgtaatgcagtcaatcctgctagaggcacagctgcagcttccgtgaaggcaatagattctggcacaggcgccagtaagttgctgtccacaatcgtataatccgcataggtcccaaatcgtgtcgtctctggacgagcgaaaatccgatcgcctacgtgatagtctttaaccttctgaccaacttcaacgatttctccagcaacatcccatcctagaataatcggaaatgaccaaggaaacatttgcttcaagtatccttcgcgtaatttccagtcaattgggttgatcgaagttgctgcaactttcaccaacacttgatccgcaccgagttcaggtagtgaaactttcgcttctgctagtttttctttaccaccatattcattaataacaactgctcgtgtttccatgtaaatcactccttgagattatgtaaatgagcttccgtcatttttctaaagaaacgaaaggtctctttcatagcttaggcaatgatccctgattttacaactgattcgactttcccttttctatcagaaaaagcagttttttcactgactaactttttattgcctttttaaaaggtttcatttattctacaggaataagaatgtgataagaaagaaggaattgatgaattgaaaagattgcacgtattttttggcgggatcattgcgatcctaggtattctttttgttggcaaagctgtactgtccaatgaaacaggaagtgcatcagcaaatgatgctaacacggttattatttataattggggagaatatattgaccccgatctgataaaaaaattcgaaactgaaagtggctattcagtgatttataatacatttgattcgaatgaagcaatggaaacaaaggtcaaacaaggcggtaccaggtacgatttgattttccccagtgaatcgatgattcctaaaatgattgaggagcagctgctgattcctttagaacatgataaactcgtcggcagtgaagatctttctgattttctgatggatcagcgctttgacaaaaacaatcattactccattccttatttttggggaactattggaatcatggttaatagtgaccaaatcgatcctaccaccattcatggctgggcagatttatggcgcccggaatttgccaacgatattctagttgttgatggcgcaagagaaacgttaggaatggctttgcagactttagatctttctcaaaatgagctagatacagcaaaccttcaacaagccatcgagaaattggaagcattacgccccaatgtcaaagcagtcctcactgatgagatcaagactttgatggtcaacaacgatgcaccgatcggcattggctattcaggagatgcagcgtatgtcatgtctgagaatcctgctataacctatgtcgtccctaatgatggcggtgctatctggacagataactttgcgattccaaaaacagtcggcaatcttgaaggagcttatgagtttatcaatttcatgctgcgtcctgaaaatgccgctcaaaacgctgagtatgtcggttatgcgacaccgagtgagaccgcgaagcaactgctaccgactgaattgacctccaataaagctttctatccagagccggaagcaatgcaacagatggaacactacgaatacttaggaaaaaatgccgttgaacagtacaacgatctttttctcgaatggaagttgggattataaaatgaatatactattgaagtcttcctacatttttgatacagaaagaaaaacgacctttgctggttttattttgattgaaggaactaggatcaaggatgtgggtcctttggatgccacacctaccaacttaccagctgaaacaacgatcattgattgtcatgaccaaatgatcattcctggctttatcgatgcccatattcacttttatctttccgctttgctccatgcagggcagttaactcatgtcactggaacaactgaagaagcagttgcccagcaagtaccgcaaattcctgtgacccatggctggaaaattgggattggttggttcagcagtgactttggacaacaagtctatcccacaaaagcaacgattgatcactactgtgacgaagtgccagtcatgctgatttcaggagacgcccacagcatttggttaaacagtaaaggaatggaaaccttagaaatcacaaccgattcagttcctaccggaatcagtggagaagcattgatgaaagatggcgaattgacgggttgttttcttgaggcagttgctattaattacttggcggaggtgctgcaatcttttcaagccaacagttactcaacgtacctttcttacatgaagcagctcaatcgttatggcattactacaatcggcgatgttgccctgactggcgaaagctgggacgacttgatttatccagagctttaccaaaaagttgccgaaaaagcgactttacgggcggttttttaccctgcgatgcgaatggaaatagagcatttaactgatatctatcaaaactatcgatctgagaaagtccaaatgggtggtgtgaaacagttctttgatggtgtaacaagtacccatactgctttgttgaaatcggagtacgaaacgccttattttactggtgatattggtatgccgctgattgcaattgaaaaaatgcgccagttgattttcttagcaaaccagcaaaattggccgatgcgcatccatacgatcggtgaccaagcgatccatcaagcgttgtctttttttaatgaaagtcatgcgcgcttccctctctctgccggtaaaaataatacactggagcatttggaagtcatggatcctgcagatctttctttagtggcacaagacaatttagttctttctgttcaacctagtcatttattagtcggctatgaaacgttagatgaagaagtaggtccgcaacgcgctagtcaaatgtttccttttcaatcctttttggcccacgatgctgtagtagcatttggaaccgacagcccagtagtgatcgatgtgtctccattggattcgatctattatgcagtggctagaaaagaaaaaaacggctctccagtagaaggattgatgccctctgaagtgatgaatgtggcagatgctctggttgctcataccgctgatgcagctcgggcactcagtcgacaagacattggttcgatcaaagtcgggcagttggctgatctttgtattctttcgaaaaatattctttccctttcagaaaaagagctgcttgaggtagaagtcactgcaaccatttttaacggtgcatttgtctatcaaaaagacgaagcttcgcagcaaaattcctaattggatctttgaccatatccctcgaatacccgaataatggctgacttgcttctctcgtccgagggctctcattcatggaagacccttgactgtgttcacgttcacgctaatcaaccgtattattcgggattttttgtcaacaccaccctaatcccccatccttttttcgttctggatactgccaggctataatttggttcctcttgattgttccctctgatcatttctcgctttgtttcgtcttgattcctgctcaatcattgccctcttgatttccctccaattccttaaaatatatacaatatgaccaacaggatcccaccaacgatttcacttattggatacttgcgattaatcggtaccaaacaattcctgcacttgccttttaagaataaaaatgaccaaatagggatcagctgccacggggttagtacctttccacagtgctcacaatgagagcggcctcccaatgattcctgacggggcaaacgataaacaacaaccatcaaaaaagaactaagacagctaccaagactaaatactgataaaatgggtaatagcaacgctcttcccaaaccacacactcctctcgtctaatcgacacctcaaataaagagcctattcataagcaaatacgctcttttaaacacgaagtttttttattcttcagcgacgtactgctgacagcggatacctagcagtacgtgatcgtctgatttatgtcatcaaattgattggatgtgactctagcctcttgctcttatttgctactgctgacacctcctttgttgcgaaacaaactgagtgttactgaccatttcttaaagaaaattcattgatgattcgaggattgatttcccacaatagtcgattccaatcctctgcgtctggaattgacttaaaaagcaaatgccagtttccaatcaattgatcactgacatattcactataatttgtcactactagatcaatatgattctgctctaaataatctaagttcatctctaatgcattcgggaaaaacaggtgctggaaccggccaagatatttgatagccattgcttggatattctgacaaacaaggtagtttccctctaataaaaatacaatatttttaggtgctccccaatggatttcctttagtgagtccatgaataggacggccatcacggtgatttctgttactgctgtctttccccctgagattgtctgatggtgttcggtaaagaatgctaataactcaagatacaaatctgggtatttctcttggacgacttcatgaatatcaagaatattttgatttgtgactggtgatagctgttcttttaaatacagcatagtaaaaaaagaacgcacaaggatcatgtctctctgaaggtcattactctgctggccaaaagcggataaaaatagttgggcacagtctgtaatcccaacattcggctggagttcctgaataaactgctgctctccagccagatccgtcaatgaacgccgacacaaaatcatcacatacaaatacaataattcctccactggcaaacgtttcccgattgacgcatcaatcacatcattgatagttgaaaaacgctggaatgcctctcgttctttcagcgcttgaatcatttctgactcgataagcaagtctccctcacgttctaaagtaatcattagagtataactaaaatctcccaaagaaacattgggatagctgctgaagaagtgctttttttgtaaggcaaaggcaatcgactggatggcaattgatggcaagaccgtgtgtggagttatttctgattcataataaaaatcatgaaagaaactgcgaatatcgatttcttttccaatgaaatccactttcttcagggacagtgtcagtcgatagcgcgccaattcattttctaccattttgaaatagcgcagcaaactactttctgagaagtggagttgatcggcccattctccgatctctttgatctgcctttgaaaaatcccttcaataatgtgaaagagtggttcattttcaagcaatgaccgctttttagtttggtacgcttctcgattggtttctttgaacaaatagcctgaactcgtgttttcaatcagaatcgactgctgaaaatattgccgaattccggtaatatcggcaatgatcgttcgtgaagtgctttttgtgaattgggctagttctttgactgatcgcgttggtattcgctcgaaggtatgcaagattttcagccatcttacagtttccttattggtaataaaattaagttgaaaatttttcatctcttttctccttactggttttcattgccgttattgactgaatcgttttccttattatacgccctgcggaggaattatactcagttgcaagcttctggcagcaccagttatcgtgatttatacgagataaaggaacccagttatgaaaaaaacggtcatcttgacaaaaacaggtatcgaattgtataaaattgttattttttgttaaagccctcttgattgtaagcggtatttttgttattctttaaaggtagaggaggtggatagtgcagtgtatgctatcaagatatttcatggttatctgacagcacaaggaaaaagaactcgagataaatcaattgctttgacttatacatgcaaagaagatgccgaacgcttcgcaaataaaattggcgggagagttaaaaaaattggataacctaaactattgaaaaagagtcgtcgaccattgattgttgaccactctttttgttttgttaaaaaatattctctaacaaatccttttttctatttgtttttatttctcgcttgtcaaaaataaaaatacactgctgcgatcaattgttgaatggccatttcttccccttttcacttctattagccaaaaaaaaatgactgaaacgtctgagttgaaacaaagtgttttctcgctcagaaacggttcagtcattttctttttatggaatagcgatagtcacatcgactgtctggatcgccacgtcataaaacggatcttctcgtcttcccaagaaatcttttgcttgagctgggaaaagtgcatacatcagtacatcttcttccgttttggcatattctttgatttcttgctcgaattccgggagctgcggtggaatcaaatctgctggtcgttcggtgatcactgcttccgtcccaatgattttttcttggatcttcgttttgattggtgccggaggacgaccgtaaagaccacgaacgtaatctttgatctcagttgggactagtttgtagcgttccccagaaatcacattcatcaaagcctgtgtgccaaccatttgagacaaaggggtaactaaaggaggaaatccaaggtcggcacgcactttcggcacttctgccaatacttcttcgtacttgtcctgcagaccttgttctgtcaactgactcaataagttggataacatcccaccaggcacttgatagatcagtgtttttggttctgtatctttgactttaggattcaagatcccttcctctcggaaccgatcgcggattggattgaaataatcagcaacttcagccaatttctttttgtccaggtttatatcaaatcccagttcttctaatgcgatcgccacagattctgtcgctggctgactcgttccccctgcaaatgaagaaattgctgtatcgataatatctgccccagcttctgcaactttcaaataagtcatttctgaaataccactagtagcgtgggtgtggacctctaatggcagatccacagcatctttgattcggctgaccaattcaaatccgatttgaggtgtcagcacaccagccatatctttgatacaaatcgaatctgctccaatatgggccatttcttttgctaattgcacaaagtattcaacggtatgaacttcgcttgttgtataagagatcgctgtttggcaatgaccaccagcttcttttgctgttgtgatagaagtcgccaaatttctggtatcgttcaatgcatcaaatacgcgaataatatcgattccgttcttgatcgatgtctctacaaattttcgcaccacatcatccgcataatttttgtatcctagtagattctgtccgcgaagaagcatctgtaatttcgtgttcttcacttcacggcgaatctgtcgaagacgttcccaaggatcttcatttaagaagcggatacaagaatcaaaggttgctccaccccacatttctaatgaatggtagcctacttcatccaatgttttgatgatgggcaacatatctgacgtcggcattctggtagcgatcaagctttgttggccatcacgtaagactgtttccatgaattgaattttcttagtcatctgcttgcatccttccttttgaaactaattcatttattttttgctgtattgcttcgactgaatgcgttctcgatcgtccgcatagttttgcttccttgtcacaaagaaagcagcgccgtcttggatagcctaacgcttcgcgactgatggactgcacttcacccgcttctagccaaagcacgtcaagatctgctaatcgcccataaggatgtctttcttcaagtgccaccatccttttctttagttcttctttttttaaaggaagtaaaagaaaatattcatagccagttttttcatttcgataaagatgaaggaatgaaaaggcatccgccactgctcgctcgacttcatccgtcaagcttttaaacacagcttctaactcatctgatgttttgacaggtccgggaatattcatggtggcagatagcagtgtgtattggggcgccgactccagtaactccttttgccgttttgcacgctgttctctagccgccaatacttctgctaatgaaacttccggtccctcaaataacaagctacacatttctcacaacatcaatgagcgtgccgtctcgatattcaatcaatgccactactttatcgccataatgaatggcttcaggcgttccaacaatctggtaagctttctcttttaactcttcgatcgtatactgaggcacatctagtgttttaaaatgttcaatcaaatcttgacgatctggattgatggcaatccctacttctgtcacgatcacatctatacttgttcctggagtgaccactgtatttactttgtcaacgatcgttggaattctgcctcgcactaagggtgaaataacgagactcattttgcatgccatactcgtatcagagtgcccgcctgacgctccccgaatcacaccatcggatcctgtcatcacgttcacattgtagtctgtatcgatttccaatgcggacaaaatagcggtatctaattggttgatcactgatcctttacttaacggcgaagcatacatctcagcatcgatttcatagtgtcctgcattgcttcctaatgaaacggctgaagaatgatcgaaatcttgtacatcaatgattttttcaaccaatccttcctccaatagttccaccattgcattggtaataccgcctaatgcaaagctcgcttttattccatctttaagcatcgcttcgcgcaaaaagcgggaaacagctaatgcagcaccaccggtacctgtttgaaaggagaatccctctttatagtaaggagaatttgtgatcacttttgctgcgtattctgcgatcaatagttctttcggatttttggtaaagcgggtggctcctttggcaatcccttgtgggtcaccgattgcttccacttcaaccacataatccacgtcggtttgcggaatactgattggtgtattcggaaatggcacgagcgtatctgtgatgatcacgactttgtctgcatattttgcatcgatcattgcgtaacctaatgaaccacaggttgcttttcccaccgtaccattggcattgccataggcatctgcacttggtgcgcctaaaaaagccacatcgatatgcacatctccagctgcaatggcccgagcccgaccgccatgtgaacggatcacaacaggattttccatgattcctgctgaaatagcagcacccacattgtctctcaatccgctggaagtaatattggttacaacgccatttttgatatggtcaatcaacggtgcatggacatttgcgatggagctaggggcaatagaaatatttttgatacccagaccagcaatttcttccaagaccatattcatgacataatcgccttcacgaaaatgatggtggaaggaaatcgtcatgccatctttcagccctgtcttttcgatcgcctcgcgaatactgctaagaagtttggtatctcttggacgaacgggggtaacggtacgacttgcttcttgatacgtatcgatatgcgccaattccccttcaaaaacaccgtattggtcagcatatacttgtggaatatcttttcctactttattcatgaccatgcctaaatatcctcctccgtaatcaacttcgctgccttagccaatgcaatcactcgctgtgcacgttcaacgattggcttgtctaccattttcccattgactgaaataactccagagcctttcgcttcggcctcgcgaattccccagataacttctttggcattctggatttctttgtctgtcggtgtataaatagcatttaccaacggaatttgtcgtggattgatcactgactttccatcaaatcctagctgcttgatttgttgcacttcattttggaatccttctacattgtccacatcggaatagacagtatcgatagccgcaattcctgcagctctggctgcatgcagaatcatgttgcgggcaaaggataattcctgtccatccggatagcgcttggttttcatatttgtgacgtaatcttctgctcctaaagcaattccgatcagtcgctctgacgctttggcaatctcccgtgcgttcaataccccttctgcagattcgatggctgccatcattttcgttgtgcccactggaatctgattgtctttttcaacagatgtaatgaccgcatccacatctaaaatatcttgtgccgtctctgtttttggtaagcgaataacctcaacgccagccaaaaccattgcttcgacatcttgggcgccacctgcctccaaactattaatccgtacgactgtttctacattgctgtaatcaaatgttttcaatgcaaagtgaaccaatgtacgcgcggagtctttttctttaagagaaactgcatcttctaaatcaaacataattgagtctgcaccatataagggtgcgtcccttagcattgctgcatttgcacctggaacaaacatcatggttcttcttaagcgttccatgaatcaatctccttccaatcatatgcgtctttttttgctgcccgatgaatcgcggtaatggttcgagcttgaatcgtacaatccaaagcgcctttatcaacggcagctactcgaacagacttgatccctaaatttttgatggtctcttcgatcacctttttgatttgttgaccaaattgtttctctacactgctttccaaagaaatttggatttcgtctgcttcagtcggctcgacagtaatcaaaatgtcgcttgactctactgtaccggctactgcgatttgtgtaatttccatatggtttcacctctcgttttttaaataatgatatgtcgttgatggcaaaaattgtctcaaacggcggtcatcctgatttttcaaggcttctctaactttggtagcactgatgatctcaccatcaatactcaatctaggtaaaataaccaattctaatgagtcgccaaacatttcctgcatcgcatgattatacgtatcggtcacctttgaatagggttcttctccgacaaaccgtgtccgaatgtctaatacaggtgctatcttctctttaaacagttgcgcatcaacctttgcctggatcttcgctactgtttctatggcactgtctttcagaaagtaggaaggaaacgttgcggaagatacaaggtaatcattggtgggaaaaactgttacattggacaagtgtgcgactccacgttttaccatttccatccgatctgcagtcgaaaactttgaacgatcttcggataacacaaagacataaacttgctgactctgctgcgcagctgtctcgacaagatactgatgtcctttggtaaagggattggcattcatcactatcccgcttccgatccccatttttttccctttagccagcgtagaaagatagctcgcaaaatttggcaatcctcgttccataaaaagaatttctgaggttgcgatgattttctgaaaccctagtgagcgaaagatcaattcattgctgggttttgaatacaagaaataatgttgttccccttcttctgccaagcgatcaaccagatgttgaatgatgtccgtcagtagattttctgattgaaaggctttgcaaacaaccaagcatttcaatatgttgtgataataggatccagtagcaaccagtaaatcgttatcgtagattcccactgtgtaatcaagttcttcctctttattcagaccggctcgatccatcaaggaagcccactgtttatagactccttgatctcttagccatagccgttttaatgaatacataaacgtctcttctttatctttttatttttttattggaaaaagtttgctaagcagcatcgaagcaagatagataatcaagataaccacgaagacgccgccccatcccagcactaataattccagtgatttcattaaatctgctgacatcgaatctctcctttcttaggttagtaaggcaagcaataaaccacctgcaataactgaagcaatctgaccagaaacattggcaccggctgcatgcatcaaaataaagttttgtgggtcttcatccgttgccattttttggatcactcgacttgacataggaaatgcagaaatccccgcggctccaatcattggattgattttttcttttctgaacaggttcagcacttttgcaaacaagacaccacctacagagtccatgatgaaggcaaccaggcctaaagcgatcaccatcaatgtatcgacttgcaaaaattcttcatactgcatttttactgagatagagagccccaacaaaatactaatgatatttaccagctcattttgagctgtgatagaaagtcggtctaatacgccgcattctctcaagagatttccgaacatcaagaaaccaactaatggcagagatacaggggcaatgagcccggcaacgacagagataacgatcggaaaaagaatttttgctgtttgcgagacttcgccagcgcgataattcatatgaatcgaacgctcttttttcgttgtgaccgccttgatcgcaaccggctgaatgatcggcaccaaagccatataagaataagctgcaaccatgattgctcccatatatttggaattcaaagtgttggctacaaagatggatgttggaccatcggcggctccaatgattccaatggaagctgcatcatttaaatcaaatccaaataaaacagcgacgataatcgtaaagaaaataccaaattgggctgcagccccaaataaaagcagaaaaggattttggagcagcggaccgaagtcgatcatggcaccaattccgataaacaaaagcaatggaaataactcggttgagatccccatatcaaacaatacttgaaaaggaccaggttccccgccagcactcaaaacaccagagttcgggaaatttactaaaatcgttcctagtcccatcggaactagtagtgttggttcatattcttttttgattcctaaatacatcaggatgccaccgactaccatcatgacaatccgtccgggttcttgtcccatccctaaaaagccttcaatcagagtttccactaacgtcacttcctctattcattaaattttttattgattcatccctattaatgaatcgtaatcaatgggtcaccaggattgaccatctctccttgattgacatgaataccagctaccgttcccgcttttccggcaacaatctcattttccattttcatggcttctaatatcatcaatggttgattttccgccacagtatctccaacattcactaagattctcaaaatcgttcccggcattggagaaggcatggcatctgcgcctgcggcaatgggtgcctcagaaacagatggtgcctcggatgcggctggtgttgcggtttgcggagctggtgtttcaactacaggttgaacgggtagtacaggttgtggtgtaccaccgatttcttccatctctactagatattctttgccatcaatcgaaattttaaatttacgtaacattgtttttcctccaaaatgctaatttttgttgattcttcgaataacaaactgactcttttcatttaatccagcagctagacttgacgcgatgatggaaacaagtttcgcctccggattgcgctgcattactttcttgaccacaaattggctcttaggttgatcacctgccgcaatggctgtcgcgatcaaactaacaagttgatattcttcttcactagcttcgatatatgcaggaaccgctttccatttcatttcagattcattatcatcgagcgtttcagaagatgtttttgttatttcttgatgtggttcactttttttgaacagtcgggcgaataatcccatgaagttactcctttcatttttttcgttctcaaccacattatattgataatggaccaatccggtagttctaaatcaaagattattgttttttttctgttcctatttcttcgccttacaacaaaaaggcttataaacattgttaaatcaacgtttatcaaccgttaagattttattaatatcttgttaagcctcttttaagaacacctataccaaattgtttttttcctgttctttttcagaattcaatctatcttatcaaatgaatattgcttattctatagtcgtcaaacggaaaagctaattgtttccaatacgtgtctttctcccccaaaaggcatgaagatttgttttttattggaatgaattggcaccgtttacaaaaacagaaattattaaatcagttgtagaaaggaagaaaaatatgttattgacggttttatcttatgccatgattattgtctttatgtttgtaatcatgaaaaagaaaatgtctccattcacttctttggtggtcattcctttgattttcaccttagttgcaatggtgtcaggagtatccaaagaaggaaacatcggggattttgttctagaaggaatcaaaacaacttctaatacggggattatgttgctgtttgcgatactatacttctcgatcatgctggacgctggattatttgatccgattacaaaaaaaatgatctatttcgcaaaaggcgatccgatgaaagttttgatggcaactgctgtcgttgcggccaccgtttctttaaatggggatggaacgactactaccctgatctgctgttcagcctttattccgatttataaaaaattaaacatgaaaatgatgaaccttggggtactggtgatcttgcaaaataccattatgaacttgctcccttggggaggacctactgctcgagctatggccgttttagaagttgatgccgatatccttacttatctggcaccaggaatgatcatctcagttctttatgtcatcttctttgttgctcgcagaatggggaaacaggaacgggcacgcttaggaatcactgaattgactgcagatgaaatcgaagaaatgacaacggtaacagaccctgaaacactacagattcgccggccaaaaaactttcttttcaatggtatcttgacgattggattgattgcatggctcgtagctagctcattcattgattcgattgcactgccaccacttttgttgttcttagttggaacgtgtattgctttaatggtcaactaccctgttttaaaagaccaatcttcacgaattggagccaatggcggagatgctgttcaagtcgttatcttagtctttgcagcgggcgtatttatgggattgttccaaggttcaggtatggcagaagcattggctaacagctttactcacattattccgaaagaattagccggcttctgggggctagttatcgcccttatttctgcgccaggtaccttcttcatctcaaatgatggtttctattttggtgtgctacctgtattagcagaagcagggcgtgcttatggctttaccaatatgcaaatggctcttgcttcattgatgggacaggcgttccacttattaagcccattggttgcctttatctacttgctgttacgtttgactggattggatatgggtcaatggcaaaaagaatcagcaaaatatgcattgggaatctttgtcatctttatcgttaccattgtgttattaggtcatatgccgctttacattccacaataatattcaggattgatagggacgggtcgtcattgcggtctcgtccctatttttattagtaatacatgaggaaatcaaagaaaatcttgaaaaaaatttactagcatgttttattttcagaggtatcatgagaaatgaggaaaataaatgagtaatatagttgaagccgttaaaaaaaatcttgatttaacacaaaacaaaacattaaacgttctgatttatgaagcgtttcgaaaaaccatcatccttggtgatattccagcaggtactcgaatcaacgagaaagtctttgctgaagaattgaacattagtcgaactcctattcgcctggctatgaagcaattagtgaatgaaaaacttgtcgaacatattcctaaagctggaatcgtcgtcaaaggtattcgtatcaaagatgcctacgaaatttatgatatccgtaaatcattagataccctagcaacgatcaaagccatgaatcaaatgactgaagcagatttccaagaactgcaaacattattagaacaaggggaacaatataatgaggccgatgaaatagagctggttttaaaaaatttctctgatttcaacgcatttatctatgaaaaaagtcaaatgcctcgcttaaaatcaattgtcctagaactacaagcctatctcgtttattttcgcgacatcgctatccgttcgacgaaacgaagagataaagcattggaagaacactggctgatttttcgcgggatgaaaacaaaaaatgtcgaacaaatcacgctgatcacgcatgaacaccttgatcgatccttgcagtttattttggcggaaatggagcgtagacaaattgactgagtccctttcgaaccagattaccgactatgccttcaaagcattgttctatgaagtcagtctcagtcctaaacctggacttgtggatcccttgacaaccggtgcgcaccaagacatgaacttattcacatttatcgatagcacgatcagcttacgtccttattttcaacagtacctacatgcagggctgacacacaaaggaacccctagggagttgtttgataagcttagaaaaatcggagtagctgcagaaaaagccatgctgcgtgcaacacatgccatcaatacgcataaaggagccaatttttcttttgcagtcattttaggggcgactggctggtacttgcaagaaaaggcattgcctttaataaaagaagatagtgagaggattttgacttacacgcagcaaatgacaaaccacctactcgcagaagatttcaaagacttagagataaagacccagctcacttatggcgaaaagctttatctggaatacggaataaccggaattcgaggagaagccgcagcaggctaccctagtttgtcgcataaactactcccctttctacggacaactgttgatttcccaatggaggaacgtttattgcggggactgattttcttgatgagtgaaatcgaagatgggaatttattgcatcgcggtggtttatccgcttggcaaacagtgaaagaagaaagcaaaaaaattcaccaagccaccttctcaaaagaagaattgcttgatgaattacaaagctatgataggattttgactcaacgccacttaagtcctggaggttctgcagatctattggcattaggtatttattttgctcaactagaagagatcctttaaacaccatcgggcaaaaaggtatagcctaatccccatactgtcttgatatagcgagcttgctttggatcatcttcaatcttatttcttaaatgattgataaaaaccatgaccgtatttgcgtctagctcactgccgttccatacgctttgatagatttgttctttcgaaaaaacttgatccgggttttctataaaaaattgcatcaattttgtttccttggatgagagcttgattggttcttcctttttgtagagttggtagcgagacttgtcaaagcagaaatctccaatcatgattttgctctcttttgaaagggcacgatgctctttgataacttgccctctatcaagggtcactgttacttgtgctcttaataagttaggcaaaaatggcttggtaatataataatctccacccatttccaatccagtaatgatgtcttcttcatttttcttgccactgagaaaaatgatcgggacaagtggatcttcttcacgtataatctgagcaagatagtacccatcgttttcatgttctaaactaatgtccaataaaaataaatcaaattttacccgtgtcatgatatcgactgtcttttcaaccgaatcactttgataaatcaagattccggtcgattggagtgatttccatatcaatcgtcgtattgctggatcatcatcaacgacaagaattttttcgtttctcactttttttcctcctagttctttggatcaaattattaaagggagcgttttttatgaaaaagccttcaagcagattgcttgttctaggaatgatgaccgtcctctttttgactgtattaggaatggtcatcacagcaaacagctatcagcagacacaaaaacatgcgttaaaaatgggggagaatcaactagccaaaatcaatgactctgtaatcaaaatattgcgattggaaatcaaatcttacactttagcactggaagattatgcttcgaatatttttaatgaaaaaaattaccatgaactgatcgaagacactcagttggacaacagtctcctattcaagacctcggctgccgccggattatatcttgtttcaccaacgggcactctcctttctggcaaagacatccatgctgaccaatttgttaaagaacctgtcaaagtcacggcttttgatcaagatcccctttatctcaaagctttaaagggttcggttcttcaaaacggcgaagcttactttgctgatgatacgtcttatgtcaatttatatcgaccggtctatgacaagcatcatgtgcttcaatctatcttggttctgccaatcaatcttgaagagctatatcagcaagagattgacacaacagaaaaccaaaatggctatacgatggtcaaaaatgaagaaatgaaagtgctcatgcacccttccaccgaacaaatcggattagacatcatcaatgggcgaaagctgaaatatcctgacctcgactacagcgatttggctcatttagaagatgtccaaaagaccaatgaaaaaggaacattaagctacaattcttactggtggacagaagaagaccccaaaaaagttttaaaaatctcagcctatgaatggattacggttggggatgcacgctggatcgttgccagttcatcggacttttatgaacgaaatggactcgcactgcaaaaaaatctgatcatacttggcttactgaccattctcttagcaatcatcattcttttagcagtcagttttagtcattacaatcgccaaaaccggacctatatcgaaaatctgcgtttagttgaacggcaaaattttttgaaggaaaagcatgcccttgaaaaatcaatgatgcaaaaatcgcaattggaaacagtaggtctgctaaccactaccattgttcatgacatgaataattttcttactccgatgatcggaaatctgcaactgttgattgaagaataccagtcaaacgaagcgctcgttgctgatctaaatgaagtctaccaagcagcgcaaaaaggccaaaacctgtctacgaatgtattgcgctttactaagactggaatcaaaacgaaagaatccctctcgatcgaagaagtggtatcaggagccattgacaccatgcgcgtactcgtaccaaagaaagtcacattgtcctatcaagcttcttttgtgggcactgcactcattgaagccagtgacttacaagttattttatacaatttgatcaccaatgcttatcaggctcagccagaaaacccgcacatccaagtcagacttagtgcagcagcagataagcagttgacagcattccaaaaccattcacttgcttattgcgacaaacattttgcgcaacttaccgtgacagataatggtccagggatcccgaaagaaatagaaagtaaaatgttcacgccttttttcacaacgaagacagagtccaatggaactggtctcggcttattcatcgtctcatcgattgctaagaaaaacgattggatcttacaagtaaaaagcaccgtctatggaacgacctttacactagggattccagtagatagcggcaacgttcagtaatcgcttgcattacttatctaagccttttgttcgttcattcactatacctttattataacgaaaaagaatgaaggtttgacgaaaagtacaataaaaaaccagctattgtttgtcgtcatcagccgaaactcattttagtttgtcacggaaattccctcttgtttttctgcaatgaaaaaattacaggatagctcatcgcgtgattattagcgccagcttctgttctgcttttatgtcattaaagcccttctcaagggctttttttgttgcagctgtttttaattgccgcgatgattttacaaaaatcaaaagttttaaggtgtgttcgctttacaaaagagaacgtatgtttgtattatacaactagggaggcgtttttgatggggagatttaattatgaagaagaaccgttacgggatattttgttcattgatgtaaaatctttctatgcatctgtcgaatgtgtccagagagggctagatcctttgaccgccttgctagtagtcatgtctcattcagataacacaggaaacggattagtcttggcagcttcgccaatggcgaaaactgttctggggatcaccaatgtcactcgtgctgacaacttgcccaaccacccggatctatataaagtttcacctcgcatgaatctatatatcaaagaaaatttgaaagtcaacaacgtttatcggaactatgtggcggatgaagatctcttactctattcaattgatgagtcgctgatggatgtgacgcaaacgttacatttattttttcctgatccttctctttctagaagcgagaagcggcacaaaatggcagaaaaaatcaaagcccatgtcttcaaagcgaccggactgcgggtaactgtcgggatcggagataatcctcttcttgcaaaattggccctcgataccgaagcaaagaaaaatcccaccttcattgccgaatggacatatcaagatgtggaaagcaaagtatggggaatttcgcagatgactgatttttgggggattggttctcgaacccaaaaacgattgactcagttggggatcgaatcgatcaaagcattggctcatgctgatccagattttttgcgcagccgtatgggcatcattggggaacaattataccaccatgccaacgggatcgatcgaacgattttagcagaaccagccccaaagacaatggaaaaaagttatggcaataatcaagtcttaaatcgaaattattacttgcagagcgagatcgaattagttatcaaagaaatggcagaacaagtcgccgcccgaatccgccgtgaaggctgccaaacacaatgtatccatctctatattggaacagcttttggagagacacagaagggctttgcccaccaaatgaaaatccctgcgacagataacaccaaactattgattgctcacgcactgttcttatttcgcaaatactacacaggacaagtggttcgtcatgtggggatcacttattcgagactggtttttacccaaagcgttcagctcgatttgttccaagatccggaagaacaactaaaacagcgaaagcttgatttactgatcgataaaattcgcgccaaatatggatttacttcaatcgttcatgctgccagcaaattagaaggcggacgagcgattgcacgggcgaatctcgttggtggtcatgccggtggaatggatggtatctcaaacgaacctcaaggcaaagcagttcgtccaaaataggatggctgctaagcattttgctatacgcctatctcttttgctgataaattgaatctgtggaccagccggaattcacagcattgctaaaaaggaggaaacaccatgtgtgggagatatttatttgatccaaggacgggtgagctgtctgattattatcaagaactagtcacgatagctaaagaacaaaacaaaaaaatcgctgttgatgaagttttcccttccaaccaggtcgtcacgctgattgccgatgacacgcagcaaatcgtaccgatcctaacccattggggctttactggtttcaaaaaaggccaacttttaatcaatgcccgagcagaaaccgtagaagaaaaacgtactttcaagaagccatttctggaaaaacgctgtgcctttccaatgtctggcttttatgagtgggatagcgataagcacaagtttctctttgactcctcggagcccctctaccttgctggtttctatcggaaccattctactgccagcggttcggaagatgaatccattattttgacgaccaagcccaatgcaacgattgcaccaatccatgatcggatgcctgttttgttgtcgaaggcagatgttttgccttggatcacggatgtgactttcgcaagaaactatctactccaaacgatgcctgatattcacccacaacctgtttcgtaaaccaaaacgccgccagaagaatttgcttcttctgacggctttttttagcgagtgacggctttaataaacagtaaaggtccgtcctgtcatgataccaaaaactgatttttcataggcagcaaaaactttttcatccgcgacaggcagaaagccttggaatgagggagcataggtctcccaagagcctgccagcgcattcggactgaccgcattgatacgaatgccacgaccaatttctaacgccgctgaagcaacaaaagcaccgattgcgccattcaccaatgccgaagaagtacccatcggaataaactcgtcttgaatgatgcctgaggtcaacgtgatactgccgccctccgttaaataatgctgtccgatcaacactagattgacttggccttgcagcttgctgtcaatggagcgctgattttcttccggtgtcaactccgcaaaaggtttgaagacggtactacccgctgcggaaataatagcatctacagtaccgatctctgaaaacagcgtccgaatactttctggatcagcaatctccacccggtagtcccctgcacttcgactcgccctgataacctcaacagatttgtcttgtaaaccagccagcaaaattttccctaacgttccggtatgtcccactaaaagaactttcatccaatcatctcatttcgcttattttttctcattctacggcagattttttctttttacaaacgttagctgtccttttcctctttctcctctttctgtgcaggtaagtcttgatttaagaggattggataaagacagctattgtcaaattacgaaaaaagtttgaatgttttgtgaaacgccttccttgtaaaaggacttctatggtataactctaaaaaagaaggtgaagcttatgaaaaaagaagaactttgtacaagtaaatcctatttagcgaaagtaatcggacaacctaccttacaaaagatcaagatcgttcgcttactgagcaatacagcgactgtcgaacttttagaagggggcaactacggcgtagccaaactcagtgacatccagccattgaccgattagcggttagtaaagactgctctaaaaaagcgtcaagcaaacaaggaaattcctaggcttgacgcttcttctatcttattaaaaaagtgagtcttatccttgatgaatcagagttgctctgactgcatttggtacatttgctgatagattcccccagcttgtatcagactggcatgattgccccgttcaacgattctaccttgatctaaaactaggatttgctcagcttgcttaatcgttgataagcggtgagcgatcataaaagtggtccgtcctttttgcaagactgtcattgctttttgaatgattgactccgtttcggtatcaacgtgactcgttgcttcatctagaatcaagatttttggatcaaataccaaagcacgggcaaagctgatcaattgacgttcgccactggaaaactcattgcccttttctacgacgggatgatggatacctttcgggtaacgcgtcagcaggtaaccggcaccaactttttctaatgcggataggatcatctcttctgtgattgacggatcattcataccgatattgctggcaatcgttcctgtaaacagatagggatcttgcatcacgatcgccatcgaacgacgaacgctgtgacggtcgaatgcttcgatcacttgatcatcgatcgtgatagtccctgcttgagggtcataaaaacggaacagtaagttcaagatactggatttcccagatcctgtatgccctactaatgcgactgtttcacctgcagatacttgaaaatcaatctcgtgtaaaacagcttgctctgggtcatatccaaaggttacttgattgaaagaaacatttccttctttgatcgcaataactgcttcttgctgtttttcaattggctgatcagcaaactcgaagactcgtttgccagcagctagcgattgctgaacattggtgatcgtttggaccagaccttcgattgggtcatagagtcgattgatataatcaataaaggcataaagcaaacctgcggagatagcgagccgaccatccaagaagaatgccgataatgtcgtgatcagaatcaggatcgttgaattccgcaaaagattgcccaatccccaggcaatactcgaatccaataacagatactttcgacctgtctgaaaccatttctcgacggtttcattgaattctttctgcagttggccttctctctgaaaggcctgaataactgccattccttgaacaaattcatttaactgaccactgatttgagaaatatattcccgcatggcaatattataacgggaagcatacttcgtatagacatgttgccaaatacccagaatcggaatcagaataagcatagccaatcctagagtatgattcaggaaaaagagtgccaagaaagccccaatgatttgaatgatattgctcatcaaattactgatgacgatcacatagaaattggagcgcaaaacttccgtgtcattcgtgattcgcgcgactactttcccagcaggaatctgatcaaaataagaaacgggcaattggtgcatatggtcaaaaagctggtcccgcattttcttcacaatgcgatttgacattttacgcagctgcagcaagctgatataacgaaagagcgagccaatcaaattgatcagcaagtaacccgctaataattggatcaagaaaaggatattcaaattccctgtctcaaccgatggagtcatgacgccgtcaatcaatcgtttggcaatcagcggtgatgtcaattccagtgcagcacctagcagtagcaatactgcaccgatcgaaaattgttttttgtaatagcctacataagacagcaggcgcttaatcgttgagaacatcttgatcgtcctcctttaactgttgatgataatattgctcttggtaccatccaggaactgcgatcagctcctgatgggtccctctttggataacatgcccctcttccaaaacaatcacttgatcggcgtccgtgatggcggataagcggtgggtcacgatgatcgaagtcggtgcatctgtcattgctttaaggtttgcgatgatcgtttgctctgtttttgcatcgacagctgacaaagcatcatccagcaacagtacatcactccttcgcagaaaggcccgtgctagcgacaaacgttgcttttgaccccctgataaagaaactcccttttcaccgactaatgtttcaaggccttctggcatccgtttgatgtcttcagcgaaacatgcgagtgataacgcttgccataagcgttcttcggatgcgtctgggtccccgaacaataggttttcgcgaatcgttcgtgaaaacaacgtatgctcttgcggaacttccgcaaagtgacgacgaatctcttctgtctgaaaagcagtcaaaggctgcccattgatcattggcatttgatttgaatacgggtaccgatgtccgaactgacgtagcaaggaagtcttaccactacctgttttgccgacgatccccaacacttctcctttggtaatagtcagatcaacgtcttgtaagacaaatcgttccgtattcggatatttgaaactgtactcagagaattcaattgtttggatcatcggtacaagttgttgtcctgtagattctagctgatcgccagtctgcaatacttcattgatccgacgccaagaagcagccccttgctgcatcacatttaccagatctcctgctgaaatcatcggccaaaccaccatcgttagatagacttggaaagataccatcgcaccaatagtgatttgttgattggctactaggaaagccccgatcccgaaactcatcacaaaactaatcgccaaaataattgtaatcagcggcccaaaacgggaatcaatctcggaaacgatgtcgtttttttcacgagtttctgttgttttttgctgaaattgctgcgtcgttgctgcttctaagccgaatgcccgtaccactcggataccatcgatgatctccaacacttcactattcatctctgaaacagagttttgtgcttctgtaaaagctttatctacttgcgaaccccatttgaaaatgtagtacgccaagaggggcataggaatcagtgcaatgattgtcaatacccaagagactgtaatcgccatcatggcaacgatgaaactcaaatagagactcgtattcaagaaaaccatcaacccatagcctacggtcattcccatgacttgaacatcgtcactagaacgagtcattaagtctcccgttcgaaaccgatgataaaagggagcccccatgtttaagaaatgcttcatcaattgctgacgcaattgcttttgcaaatcgtatgatccgataaataaattaaatgtccaaataaattctgcaatatagcctaaaagtatcgcaccggcaaacaagctgacatagcgaatcaaaattgccatcgtaaagtcatcttgaatcagtgcatcaatgaataagcgcaaaatatagatcggtgctacatacatcgcactggcaataaccataaaaataaatacgattgcataacgcaatttatgcgctttaaaatacgtcgttaattgttgtaaaatatatttcattttcttccctctcaatctaaaaaagtacacaaaaaagctctgccctttcggaaaaaggacagagcataacgtcaaaaaatatcgacactatctgtgtactaacggattaccgaataagggattaactactattttgttgtttgcgaattttgctgtaacgttttgcatcgtaatccctccttctttttttatttgctgactacaagtaacactttacagataactatgagaatttgcaagaatttttattaattttttttaaaacgattgactttcttatagtccttttcatcacttaatgataaaaaaagaccctttattcttttcccattctgaaagaattcttcttgttcttttttctcttttgtcttgataatccttagtctgtcaagacaaaggacgccattatttggcacaaaaaaaagttttttataatccgcccacaaagaaatctgcttccaaaaaaagacttcctgcatgggaagtcttttcttaaaaaagtttcgtttttcaacactttgttctttactattttaataatcgacaaactattactcgtttgaacaggcttatgaaggtcattttcgtctcttttttgccgcgctttttttgaaataggatgtccgataccagttcagaagatgaagaaatggggaacatccttttaggtcttaaataaaatgttcatccttcaaaaattccaatacttgatttttcaatgtatccgtatcagaagcttcctgacgacggttaggtgagaccgcaggctgagcgatcgattcgacggtttcttgtagagattctggcggcaattccagcaattggaaactatctactacaacttcggcaccatagacagattgtccttccttggtttcaaaaggacacatatgcaaatgtccattgattttaacacttgcacctttctgggtataccgcaaaaaagtttctgcttgcttgccgttgataacacaagcaaaccattctgtttgcaactgttcgcttgtttgccactgtgcagcgactgctaaattaaaccgtacacacgtattatttgctgctgcagaagccagttgttctcgactgggcatctcattaattttcccagtaaggatcaccttgttcgttgccacgttactccctcactctacattttatttagactcgcactaatgcaagattagccatagtctatcacaaaaaaaatttcttgcaattcttttgagaacatctatagtgatcttctacagtttttgtcgctgacttttaaacaaaatttaaccgagcttagccttcatcagtcgttgaatctatttcagagacatacgtccacgtcatgccattgtcttctgaggtaaatacgcctttgactgttccacctttgtaatcccccatgggaccttgattgaccataactttcaactttccatcttctagataaggtgcttcagcaaccacgaaaaccttcttccattcatcaggcatttcaaaagcagcttccagccacgtgtttcctccgtctgtcgtcacatagagacttggttctgttggcgttactccgccgaaactcataaagccaacattctcgttgaggtagcacgcgtccgtcaagagtcggctgattcccttagccacttgcttttcctgccaagtcttgccaccatcttgggtcacatatgagagatagccttcctgccccattacgcggccacccgataagaaaatgtaaccaaaaccgtcttggccaaatgtcaatttgcgaaaacgtacagctgctgtctgctctgccagagcaacattcttccacgtatttccttgattttccgtataagtataatagacattttgagttggactgccctcactagcatattccgttcggataaatccagtccgttcaggagtcaaaatatagctgccagcgatcagcgcttgtttgtcgccactatactcgccgccaaaaaaatcatctaacggatagggcagaatgatttgatgtttccagctatcataagttaatttcaattgactcttaccaatttctgttttatacgcaatcgtctgattcgtttcctttgaggtggtcatttgattgttcttatcggtgatcgcacttagatctcccgcatctacattcgtgatcgctttgtccccttgagcagtcgtagcaaccttaacttgccaacaaatgtcccgcacagaaccgtcatcggaaactttcccccaataagatgtcatcgtctcacgattgatcgacttgggccacacagtaaattttaccgtcagcagcccatcttgataggttgcaccactcacactgtaagaatcgatccgtacatcttcttgcaccttcacagaagaaaaatagcgcatcaaatcataaaataaattaaatccttgtgtattcggatcatagttaaattcgctttcaaagggcagaaattgattaaaataagtaacgggctgttctttgatagcggattggtttacttgagaagtctctacagttgatgattttgaaccactcgaactgaccgctcgtcctacagaaaagccaatgatgaaccagatgactagcccaatcacaatcagtgtcaaaccgacagctaacgctacccgaattgctgctatttttttatgctctttcacgggaaaaacccaccttttgttttcaattacttgaagtataatgaaaagtttcttttctcacaagatgctttttcacttcttaagaaattaagaaaagggttcctcattaaatagtttttagaaaaaataaaagcattcgcaaaaaagtgacatacttcaggctttccaaagatggaaaaactgaagtatgtcatttctaaccattctactgtttctttcatatttattcttatattgcttctctggtttcttcacacacgttgattaatggatcagattattccttcagataccttctaaacatctcctatcatctaataaatatgtgcgaacttgcgatacaaaatataatgaaccagtaataaaaagagtatctttcgatcccattttagcaacaatctccttaataccttgttgccactcttgataatatttaaattggctattttctcgaacaagatcttcttttttcaacgctttcgggtaatcgaatgtggttattataaggcaattattagggatttgctgcatctgtcggatcattttcctactatttttggttgttagcgctgaaaacaaaatatatttctttccttgttgaaatttttctgtaactgtatcaacaaattcttttatggcatgtggattgtgtgccccatcgataatgatcgtcggttgtgaactgattttctccatacgacctggccatcgcgctttttctaaagctttctgtatgctctctttttgtatcgctttgttttgctgctgacaataaagcaaaaaaagttgaagggcagttgctgcattttccacttggtattttccacataaaggaattctaagatttaaaaattgaaagtcttcattttcgaagtgaaacatttctccacttatagaatccttaggactatgactttcagggctttgcttcacatagtgaacttggtaagaggtatttttcttagagagtggcgcattttttttagaagcgacttcttcaattattttcactgcattttgcgaaatgtttcctgtaacaataggtatgttttttttgataatgccagctttttgcaaggcaatttcttcctcagtttcgcctaatatatctgtatgatctaatccaatcgtagtaatagcagttaaaattggtataaaaacattcgtactgtcccattttcccccgatacctgcctcgaaaattgcgatgtctgcgtgcttttgaaaataagaaaaggccattgcagtcaatatctcaaattctgttattccctgatagcgtgtatcctcatccatactatctaccagagggcgaaattcatttgctagctggacaaattcttctgcggagattgctttcccattaatcgaaatacgttcataaaaactttcaatgtacggcgaagtaaatgtacccactgctagcttctgcatttctaataaacaacgcaagtaagttaccgtcgaaccttttccatttgttcctgcaatgtgaatcccgatactattcttttcgggatgaccgcacagcttcagtagctcgttgactcgtatcaaaccaggccgcgatccaaattttttgcgcgaatgaatccagcgtactgcttcatctcctgttttaaacattcttatcatccccaatagaattgttagttcgtttagaaaatattacgagcgaagcgtttcaaaggaatcgcatgaccaaagaatacgatcatggctgtttgtacaggtagcatgatcaccgctttgacaatacgtattccccaaagtttcgtatcggtcaaaggaattgcatacatcattgacaaccaaattggtgtcagacacaaactgataattaatgtattgcaaagaacacatagaaaagaattttttattgtaatgggctttttataaaaaaagtagccataaagcaaacctgcaatgaatgaattcagtgtaaagccaatgaaaaaaggagctttccctaaaagagtattcccgataatatcagcaattgaagcaccaattgctgtccaccaagggccaaataaactagccataaccacttctggaacaaaatcaaaggtaattttcaacagctgggtttcaaactctaatacttgagacaaaacgaccattaatccaatcagtaatcccattgttgcgataatatgtgcgtctatttttttcttcattcttagcatctcctttaatagagctgctacacaattaatttatgcagcgaatgcaaagatagaatcgtgaaatttgtttcttcgtctaaaaggcaacatcccatccttatagcacttaacgctctatcttctactctgtttttttatttttgtcaaaacagcaatcctgttgtttgcaagattctgtttctctgatgaactagattccacttgtataaatgtttcatcttttataaccagcatttcatttttttgcaacatttgtcgctgtgtcctatcgcccagaagcactattgaaagattctccaatgcataaatgacagcaatagtctgcggtttaataaaatgcatctcatttcctttaagcgcctgaacaaagacgtcgtaatcgtctttaaaaataacattaaaatcttgacactcaccctgacacgttgtttttaatttaccatcgaaatggtggggctcaaaagcatttaggctaatccaagaacctaattgccctaatctaactggattatccaaagacataaggattcgttgataaccagtaaagtcagaaaattccacggtattcataatcactgtcgcagttgagagacggaaatcaaaatctcgtttagctaagctacttgaatcaggttccactaaaagttctgtagtctggcctccagaccactttgtggacaagtaatcttcacatgttttcttctcgattgttcccacacttcttccttaaacaatatctaattcttcaaattgactcaaaattttaatatcttgtgccacactgacaaaagccttttgatcaacatctttcatgatttgatccaaaatttccatttcgtaagtagtaataaccaaaatcagaatcgtttgagtttcttgattatatgcgcctagtgcatatggaatgatcgtgattccacgacttaatttttcttgcagagctgggataacttcattcggcttttgcgtaataatcgtcacctgaacttttttatgtttgacatacactagatctgtaacttttccacttataaaaatggataaaacactataaaaagcatagggccagccaaataaataaccggctaccaatacaatgactccattcaaaacaatcgaaatcacgccaatgcttcgaccggtgatttgtctgattgtaagaatgagcgcatccataccaccagttgaaagtccatattttaatgccagccccaaagaaaagccattgattgttcccccaaaaatggcgcaaataatcggatctgtagttagctcagtacttgggacgatgtggatggcaaatgatgcaaccgttacacaaataaccgtatagatgacaaacttgcgattaattttgaaccatgcaagcataaacattggaacattcaggagataatatataactgaaatagggacttcaatatggcttttagcaagaccagtcgcaatgatttgtgcgatcccagttaagccgccggcataaatattccctggctgccaaaaaagattcagcgccaaggaatataaaaaggcataaataagaatcactgttaattttgtaaccacctcttgccagatatctattcttttaaaacgtgacataatcctctttccttttctttaaataaaaggaagacatctcttcctctgatatcggtcaatcggcacaaatcaggtcatacctttaaaactgcagatccaatgtcacttgtttctcaatttcttttaagaaatctctatcttctaaaacggtagttgctttgtttaattcatcatacatttcgatgtctttatcatgctcaataaagtttacttgtcgacgaaatgcaagataagctgcttttgtgcctttgccaagtcctgactgatatcctttgatgtctagtgcttggcaagccgccatgatttcagttgcaacgacccgccgagaatttttgacgatttctagagctgttcgggcagcagttgtacccatgctaacaaagtcttcttgattttcacaggatggtattgaatctacactagctgggtgtgccaagattttattttctgaaaccagagatgcacatgcatattgtgtgatcataaaaccagagttcaaccccggatgtttcaccaagaacgaaggcagattacttaattggtgattcaccaatcgttctactcttcgttcagatacattgccaatctcagcggcagcaatacccaaaaaatcaaatggttgcgccaaaggttctccatgaaaattccctccggaaatcacttcaccatttctagaaatgattggattatcagtaactgaattaatctcaatttctactttttcttttacatatgcaatcgaatctttactagcaccatgaatttgcggcatacaacgtaatgtgtaaggatcttgaacatgatctggtgtcgcttccgtaatatatttactatcttcaattaaacgacgaatattacgagcggttgctaattgcccactttgcgggcgaatcgtatgaaggtcttctttaaaaggactagaaattccgtcatgaacttccaatgagagtgctcctgcaacatctgaaagttttaataactgaatagcatcatacgttgccaatgccccaaccgcgttcaaaactgttgtcccattgataaaagctaatccttctttggcacttaattgaatcattttcaatcctgctttttccattgcttctttcccagaatacaacgtgcccttataataagccttacctaaacctagtaatggtaaaaccatatgagctaatggggctagatcaccggatgctcctaatgagcctttctctggaatgtagggatggacacctacgttcaacatcgctaacaatgcttctacagtgcttaaacgaataccagaatagcctttaatcaacgaattaattcgaatcagcataatagctcgtacaatatcttccgaaaatggctcgccgtaaccagcagaatgagtacgaatcaaattttcttgtaattgcacagtgtcttcttttgaaatactgacattacaaagagaaccaaatcccgtattgactccataaacaacacgacgttcctctacaattttatcaacaatcctgcgcgactctttcactgcttctttggcactttcggctattacacattgacgatggttgcgtgctacagccactacgtcttctaaagttaggctagcaccatccaaaataatcatttcttgactaggaatggtattctgagcttcttcttttatcaacattttcatcgttttattccccacttttctaataaattccttccaagtatcagtttccacaagttttctaatttacttgcttcgatttattattgtttaagagtagatacaagatgcttgctactataactccaataactccagctattaaattgatcggattggccgcagcgaccatccaaatactaacaactatggagataattggaatgactggaccaaacggcagccggaaagcaggcacattttccatgtctttttttctcaaccaaataactgccaatgcagtcggaatgtactggaagaaacgaaagactacggacagttccgctaattgttcaaatgatccgcttagtagaaaagctatggttagtaaaccagaaaaaataatagcaacgataggtgcatttttattattttttttagcaatcaccttaggtaacaatccttcatccgcgattgaagctccatatcgcggaatcatcagagaatctcccatattcaagccagcaattgaaatcaaggccccgattgaaataatccatttcccagctggtccaatcatttcaacaaaagcatcttgaactggcgcattgctttgtaaaattcccgttccaagcatggcaatcgttcccgcaataatcataaaataaagcagcgaaacaatacttatggatccaataatcgcttttggcacattttttttggcattccgcatttctccagctactacaggtaaagcttcaaaaccaataaaagcataaaagacagtgagtgacgttgaggccatggctttagataaagtcatgtcaggattcaattgtagaaacggtgtaaagtttccttgattgattccatttttgatgaaaaaaactgcaatcagtgtgaaggcaataattggaatcaatttagctattgtaataacaatcgtaaaaatttttgaagtcttaatccccatactattaatcacagataagaaaataaccaaacaaatgctaatcaatgtattctgtccttctaacgctggaaaagtttggatcagaagtttcgcaaaacctgcagccattgcagcccacgcaataatcgtcacaaaccaccccagaacaccaacattaaatccaataaaatcgccaaatgctgttttcgaatattggaaagctccgccattcttattgaagtaacccgcaacttcggcgaagcaaacggccaacatcaaaaccaaaaccgcatctaaaaccattgcaacaagagaagcaggacctaaatcttggtaaatggttcggggcaaaagaaaaattcctgaaccaattactgcattgattccgtatagcgtcgcaccaccaaagctaaattttgcattctcatttttcgctagctctgcggagtcaatgtctttaatatccgttatctctgaaacctcgacatctttttgcatactatttcacctcttctttttttattgtaaaacgttttcaattacacgttttattctagtaagcagttcatgttagctattttacaaagagagttccctccacctccttgtaaaatagctctaaactgctagaataatccggttatatttcctttttcatcaatatcaattctttcagctgctggagattttggtaatcccggcatcgtcataacagctcctgtcaacgcaacaataaatcctgccccggcagatactttgagattacggatcatcacagtaaaatattttggcgctccaagtagtgacgcatcatctgaaaatgagtattgggtttttgccatacaaattggataattaccaaatccaagacgttccaattcctttaattcttttttcgcacttggtgccaattctacgcctgccccaccgtatactttttggacgattttatttagtttttcttcaattgaatcatccaaatcatagacatagctaaaatgatttggctcttctgctagtgcaactactttttccgccagctctttaccgccagcacttcctttcccccaaacatcagatagaacaactgcaacgtccatttctttacaagctttctctaccgcagctaattctgcatctgtatctgttggaaatttgttaatagctacaacaactggcatcccgtatacttctttaatattctctaagtgtttagacaagttaggtattccagcaaatactgcatcgacattttctattcctaaatcgcttttcttcacgccaccgtgcatttttaacgcacgaatcgttgctaccaaaacaaccgcatctggtcgtagattagctaaacgacatttgatatctataaatttctcagctcccaagtcagcgccaaagccggcctctgtcactgcataatcggcatactttagcgcaagtttcgttgccaatacgctgttgcatccatgtgcgatatttgcaaatggacctccgtgaataaaagcaggggcatgctccaatgtctgtacaatatttggctgaattgcctcttttaatagggcggccattgccccttctgctttcaaatccccagcagttaccggctccccatcgtaattatatgcaacgatgatttttctcagcttattttttaagtcagcaatatcgttagctaagcatagaatggccataatttctgatgcaactgtaatgtcatacccatcctcacgtggcacgccatttactcgtccttgaagaccatttacaatgtgacgcaattggcgatcattcatatctaccacacgtttccaagtaattctgcgagaatcaatttggagaaggttcccctgatgaatatgattatctaatagtgccgctaataaattattggcggcactaattgcatgaaaatcaccggtaaaatgtaagttgatgtcctccattgggactacttgagcatgtccaccaccagcagcaccacctttcacaccaaatacaggacctaatgaaggctcgcgtaatgcaatcactgcttttttcccaatggctgtcaatgcatcgacgagacctactgaagtagtggtttttccttctccagcaggtgtaggcgtaattgcggtcactagaatgagcttgccatcctcgttgtcatccaatgactcaatattattgatctttgctttatattttccataaagagacagattttctttagcaataccaattgattcagcaatttcttcaatcggcttcatcacaacagaatttgcaatttcaatatctgataagaccatgtccataaacttcctttctatctaccaatctaaatgattacagcgattcaagtatttgttgataggttgcatcagcaattttgctgccttcctcaactagcgattccccggctttgcggtattggcgaacaaacatttcgtctttgatgcttgcaaggttaatcaatacattcaaccacgcaccttgtaaagctgcctttaaattcaaagcagctactcccaaatcactagcagcattggtatttgatttgccaaccgcagcctgtgtgacttttaacgcatccacaattttttccatcatagaaaaaggtgtaacagctgctccttttaaagcactctgcattgcttctcggcgggcttttttttcttcttcggttgtttttgggagtccaaaaacagctgacacttgattaaaagcttctgtatcttcatcaattgccctgagtaaaccctcttgcaaagatttagcttttttttgcagtaattcaatttcgtcttcgaactctgcatatttttttttgccaatcgtgagttctgtcaccatctttgtcaaagcaattccttgtgcggcagctaatgctgaagcagatcccccacctggtgccggtgtatccgaacctaaaacagcaatgaaatcgtttatttgcatctcaacgagtttcatgacaatccccctatcaattcaataaatgattttcgaaaacttgcttattataattgaactcttcaatctgtaaataatattcagcacaatcaatcaaggcttttgctggcgttaatccgattacttcactgccaataaccgacacaccataacgttttgcttcaaagcgaatcgtttcaaacacacgatacagcggtgttttctcgaagttcaccatattcatagatacttgagcaatattacgatcttcaagcatgacaccaatacccttgcagtatttccatcctccagaggatccgcgaacaattttagcgattttattggcaatctcaatattatctgtatccaaattcacattgaatgcaactaaaggcattctggcacccactgctgtgacaccagcggttggatgaattttgcgttcgccataatctggttgccattcttcttccaaaagtttttctggcattttctcaaattgtcctttgcggatcttcgctaaatttttacgtacgggtgtagtggctgaatcttcatatagaaaaatgggaatctgtaattcttcattgattcgttgagctactttcttagaaatagcaatgcactcttccatggtgacatctttgatcggcacaaaaggaaccacatctgttgcccccatacgaggatgttctccttgatgcttcgtcatatcaatattctcacttgcaaacttcactaattgaaatactacttcttggattccttcttcatcaccaacgagtgtaaaaacactacgattatgagatgtgtcagaagaatgatccaacaatgtgacacctttaacattcttagcgatctccaccaacccatcaataaccttttgatttcttccatcactgaagttcggaatacattcaattaattttgtcatggtctattgctccttgtttttattttgaactttaggtacggcataaatttgttcttactacattaaaaaaaatctatgaatagcgttatttttatttcaacacctcctaatatcccaatttatttgttaccgctttcattcaccgaaatcagcttatcactctttcaaatcggttgcaaactccgtaaaaaaaagcttttcataattttttcataattaaaattctgtttttttttggaaaattctcctaattgtcttccgcatttttttgtcttttattttatttgacctttttttgactttcttttttaaactgaaggtaacctatcgttgcgcattgaataaaaaacaagacagactttatttaatctttttgatttcttttacaaagtactttttttgcttgaataggtacactcataaacaaaaatttgtaatcaacacataaaaaatcttcaagttttatttttgacgtttaatagtcggtgcccttcgttttttatacataaacattagaaaaaaataattattatgccgataattcttttgaacttttggaaaattatcagcaaataaagaggtggaaacatgaagaaaattgttttgttgattgattttggcagcacatatacaaaattaactctggtcgatcctagcgccatggaagtccttcatacagctcagattcccacaagtagtcaagacgggttacagttgtgctatacagaagggaaaaaagcattacttcaaacgttaaaattttctgatcaagtaaagatagaagaatatttctgttcttccgcatggggaggctttaaaatgattgccattggtttaactgagagtttgacattagaagcggcgaaaagagcggctctgggggcaggcagtcgtattcttcaaactttttgttatcgtttgacactggaccagcttgaggaaatagaacaacaaaagccagatgttgttttgttgacaggagggtgtaatggtggaaatcaagaaatcatccgtcacaatgcccgtcttcttactcagctttctacagagattgcattgattgtagctggcaacgaagacagctatggagaattatctaagctcttgcaagatcgaaataatacttactttaccgaaaacgtgatgcctgatgttaataagctgaatcctattccggttagaaaaattgcccaaaaagttttcttagaaaaaattgttcattcaaaagggattcatcaagttgcagctcacgcaagtgcccccatcatccccacccctaaagctgtattagctgcagccaagctattaaaagaagggacacaagcttcgaaaggttttgggaatttagtcgttgttgacattgggggagcgacaacagatattcattctgttggagatggtttaccccaagcagaaaatgtttactttgaaggattggaagaaccctatttgaaacgtaccgtagaaggtgatctcggtatgcgttcttctgcagtaagcttgctaaggtgcattgtagaagattccaatcgaatcagggcattgtcttcttggaaatttacgactcttcaagctgcttgctattatagatgtagtcatccaacatatgtaccaaagacacgagaagaatgcctaattgatcaatttttagctcaatcggcaacggctatcgctttagagagacatgctggaaagataagaaaagaatatacgccaaatcgtacaatctactaccagcatggaaaagatcttcgaaatttccaaacaatcattggtactggtggcgttatcattcatagtcaatctcctaaaaaaatagttaaacctgacatcaagggcatgtctaatactttgctaccagtagatccgcaaattcttattgaccaagactaccttttatctgcaatgggacttttaagtcaaaactatcccgaagcagcattgaacattctaaagaagaaactttatcgactcaacccttagttgtgaaaagaagctgtgacaaaagttttgtcacagcttcttctgaataagcggttagtaatagctttttcggaattttcttctcatttcttgaaactgatcacatctgtcacagcctcagatatcaatcttatagatttacatgaaagaattcttttaaaacttgcaactcatagcggtctcgatattgactaaggttgtccattgcttttgtcaaatagtacgataaatcttctttaaccaaatgatttaattgtagatttgcatgcctctcatttagacacttttcttttaccagtgctttgataaaataaacgagaccactatcacgcggattagctagttgattttggtaacagcttgtcttttcaataaactctatcacttttccataatcttttttgtgaaggtaaattaatgttaaataagcatttaactgaacccttttccataatgaagtagtaacttcaaaatattcatttgccttgagaaaataggtttccgcttgatcataatctttttttgcatacagtgtaattcccatatcaacataaaaaatagccaagctcgtcaccaaattatttccttcacacaaattgatggctttttgttgcagtttgatagactgctcatagttagaccgcaaacgctggatttctgctagataatcatacgcggcagcaatattgctgttatacttttcgtcaaaacggttggcaatattaaaaattgtaatcgattcttggatgtacgattctgcttgatccaaatcaccgatcatcagatgatacaaacctttcaatcgcaataaaataccgatagattcgttgttattggcagtaattgctacatccattgccaaatcgatataatgtgccatgtccgtcgcattatcagtttgaatatagtaataaatcatttgacgatacccgcgcaataaataggttgttagatgaaagtctttcgcttttacgattactcgctgaatgttttcaattcctcgattatagtccccggaattgatgaaaaagcgaccttctagataaagaaatctgacgagcaacaactgataagtactatcttctgcatactgtccttcaatttctttaagtcttgcacctatctctttgaatttttctaattcatttggggcttctcttctgaccaattcacgtgatgccaaatgttcttgatgatagattggaaagagttcatgttgaatacgtaaaaataattgatgatgagaaagttcataatctaaggacttaagttcttgatgcgcctgacgatagtgatacccgattgctgccaataattcgctatcgttttttgcttcatttaacttttgctctaataaaacagcaattttttcatgtatcacacgtaatttcatatctgattgttgtgcataaataaattgtttcatcttattatgtttaaaactaaagcatacttcatcgagataaatattctcattgatcaatccttgcttgattaaattatcgagcgctttataaacctctgctttttgaccatcgactaactcaattagtacactcataaatgctaatttctgaaagaaagaaatcaagtcaatcaattccacttctacaggcaataagtttacaaactgtagactaagcttatcctttatgttttgcgttaatctttccaatgtgttgctctcttccaattgatttaagtactcactaatgtacagaggaacaccttctgattctctcataataaaatctattgtagatgtttggaacgtatgattaggcaattgtttctcacaaaaagccctgacctcaaaatcttgaaatggaagtaatttcaatgtgataattttttcatagcggcgaacgcttacgataaagtcttgtatttccttgcgaaagcttgattgcaatgtcatgataaaaatgatatcccgatgggggttatgcagaattaaactcgttaatagcctaatactggttcgatccatccattgtaagttttcaataaaaatgacaacaggagttattttccccaactgttgcaaagcttccgatatgcattgtgctaaaaaatttaactcaacagaatcaatggaccgaagtacgcgttgtgctattaaatcattaaaaaatggaaattgttgactaaatgtttgttgccattgactaacttcagctagcttttctctttgcaataaatggatgatctgttgcagtagttcacgccatggacgcaagcaatgctcttgttccgttttataacaagtcactttgaatagctcataaggatattgaatattttctatgactaattgacacaatgaagactttcccacacctaaatctccagtaactaagaccgattgaaatggctttttttgttttaaattcgccaaattcaactccaagcgctccacttcattggatcgaccataaaagtgattcgcgcgttttttttgacttactcgctgtttttgattggcaatctgtaatgttctttgatagagctgttttgtttcttcacttggttcaattcctaattcatctctaagtgtctctaccaattcataataggtttcaattgctttcccattgcgatgattttcaatataaaattgcatcaataattgataattgcgctcatcaaattcatcaattgcaattaattttctgatatttttttctacatcggctacggcatgaaatgaaatgtcttctgcaaccttttgatagcagcattcaataaattgatgttcatagagattacgcatcttagtcaaccatgcatcaaacagatcggaatctttcaaataaaatccttttaaaaattcatcccgatagtcttccagatgagcataagcatccttttcaaaacgatacgtatcactctcaatgattaaatcagaattaaacgtcaaaatagatttattcggtgaaacaataaattcccctcccaacgagcgatttgcttgataaattgtatttcgcaaattcttcttggcacttttttcatctttactaggccataaaatacctgctatttcatcccgactaatttgtttgttgatcaccatgtaatacagcaaagcattgatttttgaaaaagaaaaaatttttatgttcccatccacttttattgttggtgttcctaataatttaaacgacaatgtatgctccatcactgctccttctttcagttttactaatctttattttaaaacaaccaacctaataaagataccgcttacaacactgtccattataaccttctaaaccttctaaaccttttataagaaaaactctctaactctatcactagaattggagagttctctgcaaaaagatttctaactatgctgacgttgcgagacgacaagatctccagccttatatacatgtgtaaccaaattagtcgcaaaaaaatacaatggaaaatcgatattcggtgcatcaaaaatagtaatatctgccgattttcctttgtctaggcttcctacgctctttgatcgacaaatagaatacgcagcattaatcgtaaccgcattaaagacttgaattggagtaagcttttgcataaagcaacctaactgcataataaactgtaaatttgctgttggacaacttccagggttactatctgtcgttaatgtaattgccatacccttgtcgatcatttttcttgctggtgcatacgtgtcttccattaagctaaaggtggttccaggcagcaaattcccgataactttggcttcgctcaactttctgattccttcgtcagttatcatcattaagtgttcagcactaactgcacctaactgtgcagcaatatctactcccccaatcgatgcaatctcgtccgcgtgtatacgtaatttaaatcccatttcttttgcggcttttaacaatcgataagattcttcggcagagaaaaccccttcttcacaaaacacatcacaaaattctgctagtttttctgcttttacttttgggagcatttcatcaatgattaaatcaataaactcattagaacgtccctgatactctgctggaatcgcatgagctcccataaaagtagaaacaatatcgattgcatgttcgttattcaatttttttgcaacttccaattgttttttttctgtttcccaattcaatccatagccgcttttagcctctactgttgtcacaccatgcatcagcattttatccagcagatctgcagatttattatacagcgtgtcaaatgaagcttgtctagtcgcattcattgtacttaaaatcccaccaccatcagctaaaatctctaagtaaggcacaccatttaatttcttggcaaactcatgctctcggctaccaccatatacgaggtgtgtgtgacaatcaattaatccaggtgtcgctagtttccctgtgtaatcaataatttccgtatgtttatcaaccaaatcattgtttggctgtccttcccctacgtgcaaaatctttccatccttgatagcgatatagcctccgttgatgattatcgcttcactcatctgctttcctctcaatggtgcaccctgatcaatcggacaaaaaatttgactaaaattgtttaaaattttttctgctttcattattcttactcctctacaaattattcatattctgagtataaaaaatcatagtctaacagaagtcaaacgatgcgtctcaaccatttataaaattggaataaaattatttgtgcggatagacgtttcgttgacaccgcttatatatactgagaatcgtaagccgattaagaatattttattcattcaccattattatacacttgaggaggaaatattaatgattcaattacaagacatcgaacaagcgatgacagttaagttagatgactttttacctgaaaaaactatttttcaagaaggcattcgccgcgcacctgatcgcggattccgtttaacaaaagaccagacagaactcgcattaaaaaatgcattgcgttacattcatccaaaatatcatgaaatcgtgattccagaatttatagaagagttaaagacacgtgggcgtatttacggttatcggtggtatcctaaggaaagaatctatggcaaaccaattgatgcatataaaggtaaatgtactgccgcaaaagcaatgcaggtaatgattgataataaccttgattttgctgtggcgctttatccctacgaacttgtaacttatggagaaactggtcaggtttgttccaactggatgcagtatcacttgattaaaaaatatctcgaaatcatgacagaggaacaaacattggtgattgaatcaggtcaccctttgggccttttcaaatcaaaaaaagacgctccccgtgtgattatcacgaatggattattagttggggaatacgataatattgatgactgggaaattgccgaagaaatgggagtaaccaattatggacaaatgaccgctggcggctggatgtacattggtcctcaaggaatcgttcatggcacgttcaatacccttttgaatgctggtcgtttgaaacttggaattaaagatgatggcgatttagctggaaaactgtttgtttcctctggacttggtgggatgtctggcgctcagggtaaggctggagaaatcgccaatgcagtggcaattattgctgaagtggataagtcacgaatcgatacaagattagaacaaggatggatttctaatcttgcggaaactccagaagaagcaataaacattgctacaagctatctaaataaaaatgaaaagacttcaattgcctatcacggcaatattgtcgatttattggaatacattgaccaaaatgatgtaccagttgatttactatctgatcaaacctcttgtcataatgtgtacaatggaggatactgccctgctggcattacgtttgaagaaagaacaaaactattagccacaaatagtgaaaaattccatcagctagtggatgaaacattgaaacgccattaccatgtaatcaagtcgcttgttgcaaaaggcacctatttctttgactatggtaactctttcatgaaagcaatctatgattctggcattaaagaaatctcaaaaaatgggattgatgataaggatggcttcatttggccatcttatgttgaagatatcatgggaccaatgcttttcgattatggctacggtccatttcgttgggtgtgcttaagcggtaaacacgaagacttggtcgcaacagatcatgctgcaatggaagtgattgatccgactcgccgttatcaagaccgagacaattacaactggattcgtgatgcagaaaaaaatcaattagtcgttggtacacaagctcgaatcttataccaagactgtatggggcgagtgaatattgcacttaaatttaatgaattggttcgagaaggtaaaattggtcctgttatgctaggacgtgatcaccatgatgtttctggaacagattctccattccgtgaaacatcaaatattaaagatggaagtaatgtttgtgccgatatggctacacaatgctacgccggaaatgcagctagggggatgtctttgattgcactgcataacggtggtggtgtcggaattggcaaatcaatcaatggcggttttggacttgtactagatggttcagaacaagtggacgagatcatcaagtcagcgattgcctgggatacgatgggcggagtggcacgtagaagctgggctcgaaatgatcacgcaattgaaacgtccattgaatataacaaaatgaatcaagggactgatcatatcactatcccttatcttgcagaacaaagcagcatcgatgccgcaatcaatgcgctttttgattaaatcaaacacggattattttttcccaggaactgtgatataagtactttttaataaactaaacatctgaactgcatgataccatttacggtgaagtcggtcttcagcacaatcataagagaaagacaattcatcattatagagaacggataccttttggctagtttatacttctgtcacacttccttttttaagtgatctactgaaaggaagcgaaccatgtacgcaccagaagaaattgttgaaatagcaatcaaaaacggggcaaacaaaacaaaaaaaacactaatagcaaaatgtttgttaggctttattggcggtgctatgatttctttgggatatttagcttatatccgagtatccgcccccataccatcaaacttttccggattagggacattgttaggatcagcaatttttcctattggattaatcgtcattttactagctggcggggaattaatcactggaaacatgatggctgtaacaattgccttttacgatcaccggatttcttatcagaagcttgtaggcaactgggtattgattacaatcacaaacatgattggagcaatttttgttgcctatttttttggttactttgttggactgacgcatactgatgtctttagagaacaggtcataaaaatagcgcagcacaagctaaacacttctttttcacaagccttcatttccggtattggctgtaactggtttgttggactcgcattatggttatgctacggtgcaaaagatgcggcaggaaagattctatctatctggtttccagtcatgattttcgtggcaattggattccagcatagtgtcgctaactgctttgttattcccgcagcaatctttgaaggagaagctacttggaaagcgtttgttttaaattttatccctgtctatctaggaaatatagtaggtggtgcagttctcgtatctggattttattatcttagttattcagcaaaaaatgctactaccaaagataactagcacagaataaaagaagatgaacatatgtatcctcaatacgtatgtttatcttctttttaagacgtattcctattcgttattttccactataaaatagttcagcacctacttcgcaaatgcatcttgccctccatacttattctggtggatgatctcactgatcaagtactcgtagatggaacgcggaatctgtacaccatcttgctttgctttctcaaactgtagttgactgatctcgcctggataatagaccgttgattgtccttctacaggcggaatttcatgtaattcatttaccatttgatccatctgttctttaaatgccgaaagatccgtaaagcgtttgggatcaatgactagaaacatttgtcctaggcgtcttttttcagtgagatcggcatacatagaagatacatgtttcccgaaaggcagtcctaacagtgaaccggctaaaatatccaccatcatcatcaagccatagcccttggcgccagcgatcggtaataatcctttaacgtccgtaggatctgtggttggttgtcctgtctcgtccactgcccaattttctgggatcggctgatttttggctcgggcatcgagtattttgccccacgcttgaacggtggtagccatatcaaaaacaatgggttcatgtcccgctcgtggcgcagcaaatgcaattgggttcgtgccaaagtaattgcgggtaccgccaaagggaactgccattggatctgattgacacatcgctaatgcgatcaactcttcttctgccgcttttttgacataataagccatggtaccactatgactggtttgttcgacaccgacataggcaattccagcttctttggcaagatggatcgcaatcttcatcgcttcattacagacgtattgtcccatgccattgtcgccatgaaaaatccctgtagcagggccggttttctcaaaagataatttaggcgccaatgtgattccgcctttagcgatccgttcggcataatagtccatgcgtacagcaccgtgggaatggacacctgttgcatctgcaatagctaaatgtttcgccgtttcgctggcagcttcttgcggcaacccagcagcaatcagttttttcttcatcaattcttccaattgagtaatagaaagagtgactagttcttccatcgtgaatcctcctttaacaataaaggagaagtacctgatagtgacaacagcgacttctcctttctcttattgattaaatatctgatagtccaattcatccgcagatttcgcaatgatcatcgcagaataaacatctgaattgacattcaaaatcgttcgcagcataccgacaaaccattctacaccagcaaaaatcgcgatactctcgattgggagtcctaattgagggacgacaatcgccagtgaaacgaggccagctcccggaacaactgcattcgccaaggacacgaatgttgcagtgacagccactgtaatcatttgtatcaaatcaaaaggcatttgatacatctgggcaatcgtcatcactgtgatcgccatatgcatcgcagaaccattactatttaaagacattcctagtggtaagactagatttgtgatacggctgcttaatcccagcttatgttgggcttcttccatagcgaccggtaatgtgatggcggacgaggtagtcgctaatgccataatggtcatatttttcatattttggatcaagcgccatggattcacgcggcaatagatcatcaaagcaacaatccataaggcaagaaacgtcagtgtggctaacccatagattagaagatactttcctagaggtaaaatgatctgtaaccccaaagaactgatcgttgaagcaatcagcgcaaagatcccgatgggcgctaaaatcatgacatagcggatgatcgtcagcacgacttcattcaagtcaacaatgattgttaataattgcgactgcggattcttttgcaaaaaacgatttaaagcaatcccaaaaaacagggcaaaaacgatgatctgaataatcgatccttttgacaaggcatcgaaaatattggtaggaataaaattgatcagcgtctccgatggtgagatttcttgcgcttggacagtgtcagcagccgtttgtgaaaaatcgatccctttaccaggggtaaagaaaactgccattgcgacaccccaagccgcagcaagtaaggaggaaatcccgaagaccgcgattgttttcccacctaaccgtgtcaattctttgggggcaatgcccccaacagcctgaatgatttgccctaagatcaataccggtattgccatttgcatgagccgtagaaaaatatcgccaacgatttttaagtgaacgcccgcttgtgaaaacagcaatccaaaaacgatccccaacaaaacagcaataacgatttgtgtgaccattggtattttttttattttcaccttgatcccctctttatttgcggagtatagtccctacctgttgatcaagtacagctaaattttcaattgaagtaatgatcgctgtccttgacgcatcctcgtttacaaagccgatggctgcctggatcttcggtaacatactgccagcagcaaagtgtccttcttcaatatactgttctgcttgctcgacagtgatttctttgagagcttgttggtctggttgattgtagttaatgtagatattatcaacacccgttaaaataatcagacgatctgcttggacattgtctgccaaaaccttggctgcaaaatctttgtcattgactgcttccacgccaacatagtgctgattttcttgataaacaggtaccccaccacctccagcacaaatcgtgattaccccggcatcgactagggtcttgatcacgtctttttcgacgatttcttgtggcatcggagaaggaaccacttttcggtagccccgtccggcatcttcttgatagacacccccggttttagccatcgctgcttccgcttcttctttatcataaaaaggaccaatcggtttcgatggtttctggaaagaaggatcgtttttatccactctgacttgtgtgattaaagaaatcacggattgcggcacatcccgttgggcaaattcattggttagtgcatgttgcaaccaatagccgatacttccttgtgtcatcgcaacacaggtatccaatttcagctgtggatttttttcgctttcagcagctttttgctgaagcagcaaattaccgacttgtgggccatttccatgacacaaaatcacttgttcgcctttttcaacaaaatcagcaatatatttggctgcttgagcaactaccgctttttgtccactatcactagggtctttatccaaaatggcatttccgcctagtgcgatcacatttaaactcattttactgtctccttctcattttccttcgctaatacggcaaatattcctaatccgatcagcagcaacacacacgataagtaaaaaccgacttgcattgatcctaatgaatctgctaaaaatcctgtgacatatggcgcgaggatcgaaccagacattccgatgaagttgtaggcactaagcgtcgtgcctaacgctccggctggtgcatttttcgttacaaatgtcaccacgattggatcaagagcaagcttgcccgtcaatccatacaaaatcaacacggcgatcaatatcgtgcggtctgtaacaaaggcaatcgcaaaaactgaaagtgtcgcaaggggtaccaagaaatacaccagttttttcgttgctcctgttttgtcgttcaaccgagcaaaaatcaaggcaccaggaatcgaagcccatgggacgagagaagcaataaatccaacacttgctccttcaaatccacgttctgcgatcaaaaattgtggtaaccatgtaatgataacaaaatttgcataaatgctagtaaaacataagataaaggcagccactaaattacgattagaaaaaatttgtttaagagagattttttcttttggtccttcttctttaaccactttttcttcatcttcaggacggatgactttctctttcaataccgtgtaaaacaagataccgagaatcaatgttgggatcgccatgataaagaatggtttgctccaatgatcgccattatccaaaacaagtttacttgacaatagatacccgccagaagtcccaaaagccattccgctgttgataatcgcattcccaacggttcgtttgttatctggaatcgcttctgttgataacgcgtattgaggcccataatacgcaccttgaccgataccggcaactgcgcgaatgactaagaacaagacaaaactcgtagctaatccactgaaatacgtggtcacggccagcagtacaaaaccaatggcaatgactagctttcgaccgattttgtccccaacgatcccaaaaggaatttgggctttagctcctttatcaaagaaaatcagctggaacgactgcagcaaagcattcccccaaagttgtaccaaatgtcagaagaagacgaggaattattcactactttctatactttttttatcagcaaccgcaattacaagaaaactgccgaggctctttttctgcattcgaaaacgattcgctatcgtctcaacaaaatcgagcagttgctggagattgatttgacaaatcctatccaattggtcaattatgaaatcggtacgtatttattagaattgaagaaaaggagtcgtttataaatgaaaacagactttttattatctaccggtgcctcagttagtctttatcctgctgattccattgagcaagagagctatctgatttacttgcatggcggtggattcgtttacggcagtcggcaggatattcccaaaccattgatcgaattgtttcatgaacacaactatacgatcctatctatggactatttgttggcaccaaacagttcactttctgaaattattgccgctacctgggagaatttcttggaattaaaagcgaaagtaatcaaggagcacccttatcgaatctgcggtcgttcagcgggagggtatttgatgatggcattgacgaaaaaaatttttgctgaaaaactgccaatgcccgaaagcctaattaacttttatggctatacagacttagctttcattgaaacttctcgtcagacgactcaaccaccattgtctgagtcccttctgccgaaaatcgagttaacagagaaagtatgggatgatccccagtttcagcgttatctcttttatatttatgcacttcagcaacaaaaattgactgaggtatatggcatttcctccaatcagttgacggattatgcgctcccagcggaagagctacaactctttcctcctgtttttagtacagccagcagtaccgatgaagaagtcccatttcgctatagtaaggcattaaagaaaattccagatagtaaatttatagctgtttatgacctgccgcatgacttcctgaaagaaacagatgatgaccaagtccaaatggttttttcccgtttaaatacctggttaaatgaccactgacaaaaaaactaaaacaaaatcatttttgacaggcagcagagtgttataaaaagaaccctctgctgcctttgatcaatttttcttctctttcaacttgaaaatcagcaaataatgcttacttacaccaagattgctggttacatgctatactaaaaatgattatttgaaagaaagaaggatgaatttaatggaatttgtgggtatcttatgcctaatcctcctcacaacaactcttttctctcatatagcaagacggattggcgtccctgctgtaattgggcaattgttggctggtgttttattaggaggtgcaggacttaattgggtacatccagacattttagtacacgatttttctgagatcggtgttattttgctaatgtttttagctggtttagaaagtgatatatctttactgaaacgctattttcgccctggaatgtttgtagcgatcttggggatcctcttcccgatgttattcggctatctcacaggtatcggatttcaaagcagcggaacggaagccttcttttttggtattgttctagcagcaacttctgtcagtatctctgtcgaggtactcaaagaactaaatgttgttaataccaaagagggttcgacgattctaggcgcctcagttgtcgacgatattttggtcgttttggtattgagcctcagcctttcctttttgggaggttctggtacgcaaagcacccctttgcctgtcacactatttgtagaacttatttattttgttttgatcttcttacttgttaaatggattgcgccgttcttactttctttagcagaaaagctctttgccaatgcctcagtcatcatcatgtctctgatcatctgtttaggtatggcttatcttgctgacttagtcggtttgagctctgtgattggtgctttctttgccgggatcgctgttagccaaacaaaagtcaaagaagaagtggaacacagtgtagaagcattgggatatgccgtgtttattccagtattctttgttagtgtcggcttagaagtagacttttctttgttgaatgagcaattactctttatcttagcctttacggtagtagctattttgactaaacttgtcggaggttttgctggcggaaaaatcgctcagttctccaacaatagtgcttggatggttggtgcagggatgatatctcgcggcgaaatggctctgatcattttacaaatcggacaacaaaataacttgatcacacctgctctttattcacccttagtaattgtggttttattgagcacactgatctccccactgattttgaaatattttacaaaaaaaatctattgatgcatcgtaaaaggcaaaacaccttctcaattcagttgagaaggtgttttattgtatttaaagcaaaaaaacattacaataaagctatataggatcaaaaggccgacaacacaccgtgaaagggcgtattctcatgaaaatcatcaagaactccattgaaaatcaccaaaagaaaaaagagcaaaaaaaactgattttaagaaaaaagaactttgaattacgtgaaagaggaaaagatcctcataaagggtggcaccccatggtcgataccggatccggcggtgcaaatggtgcactcgttaaaatcaatagaggcaccatcgatattaccggaaacaatgacgaaacattcaactattttttagaagaacaaagacgagttgctgatcattcaaaaaggcagaactaactcttgtttagaatgactggcaagagcacttttcaactgcttctacgataaatactattcaatccagacggtctcaatcagtaaatataatagtcatcgcttcctgctggatagatctcgatcactaatttatgaggcaaacagatactggtttgtccattttgagagatccagcccgttttaacagcaatctgatctggactattgtcttctttcacgcgaattttcccgttatttatttcgataatattatattgttttctagacggagcatacgtttttgtcaatgattcaatttgttcgagattgaatcggtcaacctcctgcccgttgattcgaacaatggcgtaacgatcacctgtatgttccgtagcttgggcagagaaaaagactggcagaaaagatcctacaatcaatgcagcaaagaggaggtaatcaaagggttttaataaacgaataaaagaatctagcagcctcattcgtatcacctctttctttttttactgttttttctttaaaacagctagtcgtctagttatgtcctttgctgatttcaataattgaataaaaaggcattggcaaaaatcacctgattttgccaatgcctttttattgaatacaattaaaatcataaatgattggttgtgctcatcatgcgtttcaatggatgcttcctgtttttgcatcattgtcagctgtggctacttaaatcgtttcttttttaatggtttcaatcatttgatcgattgcttgtttgatttcatcttctgtatcgggtaatttgcttggtaccccatcatgcttaccactgtcgacttctccggaaaaacttacttcatcccctgaaacattgatttggtcttgatacccttttacagcgatataggctttggcaagcacctcagtttctttcacatcttcaatttttttcattgtacttcccctcctgaatcttattgtagcaacttctatttaaaaaccaaattgatttgctttgtttttcccagttttaatatctccaaaagaaaaacgaaagtaggaagggctatttttcggatggaaaacaacaccgtttttttgttaaagtatttgcatatcttctattgaaaaaagcttttttcaattgatctttctattcgatagttggttctgataatctacggtcttcaaaataagccgataaatcaatcaattcatcctctgtaaactgattcatttctacttcacctaaaatcctttcttgcagtgttcgatccatttcccagaaatggtcgatctttttgaaatggtcagccgaaaacctggcaaatactggataaagaatcaagaagtcagtgtatgtcaggtccatggactctgtataatcctttacgtaacctgaatctaatgcttctttggttggttcaccctttggcccaatcaatcctttgtgatataacagctgaaaaatttctgctttagtgactgtcggatcaactttctttttgtagcaataagcctcttcaaccaatgatggatattggatcatcattattctctacttcctttcagtcatttgctttcgttatgatcggtttcttcaaaagatattcctttaatgacacatggtgacttcgtgtataattcccactggtactgtcaaaatggatggctggcttcttcaattgttgatttctccgccgccggtttttctttgcctttgaagtttttctagctggtactgccattttttaatcctttcttggaaaaatagtttcgttagctaatttttttcttgttccgcttgtattcatggataatttttagcgcacgcttgcgagtcttgatatttggatttttcaagcggcgataagcacttgccagatctgttttttccaatcatttttcctcctttatcgtcctacttctctctttaagattcatctgtattctttactcacttctttatttcacgaaaaattgcttttcgccgtagttttggtgaatatttttttaattccaatcgatagggtgtgttgcgctgatttttgctagtcagatagagtcgttctccggtttctacacattccaatataatattattttgcatcctcaaactccttccaaaaatctcttcaaaaacaaaacgtaacgattacgttttaaaccttatcatagaagagtagaagattcaagaagttttttatatttttgttattttataaatgaaagatgtttcatatgagtcgttgatcgtttctgaaaaaaattctatttaataaaataccagaaataaaaatagctgtttctctctttaaaaactttgatttaacaaaaaaataagatacccgcaagctggtattttagaacaacttcttaaaaattgttctagtaattatccaatactttactggtatcttgttttttattattcgtgtgtcttcatccattccgtgatagccgataagcgttcaagacgtagattgggcaacccgctgcgagaaaggccatgactagaatgcggaaagaggatcaatttcgtgtcaatgtcattccgttttaatgccgtataaaattgttgcccttgttcttgcggacaacgcagatcattttcgccatgtaaaacaagcgttggtgtgctgacatgatctgcatacgctaatggtgacatttcccagagtgtcttagactcatctaggtcatgcagcaactgatattttacgaaaaatggtccaatgtcgctggttccatagaaactgatccaattggagatcgaccgctgtgtgacggcagagcagaaacgatccgtgtgccctacgatccaattggtcataaagcccccataactaccgccaacgacatgaattttttggggatcgatctctggatgatgattaagcacgtcatccacacctaagagcaagtcttggtaatctttattgccataatctcctaggatcgagcgaacaaactcctgaccatagccttgcccaccgcgaggattcagcaatatcactccgtaaccattggctgcatgaacttgcatttcgtgaaagaaagtctccccgtagcaaacttgcggtccaccgtgaatatataaaatcgcagggtgctcttgactggtctcgatcggtggtagataccatccttggatttgccaaccatctgctccctcataccaaaaacgctgcggttcactgatcgacagttcattcatcagagcttcattcggatcagctactagttctagctcgccactagttaagtcaagcaccgctagtcgacttgggatcgttagtgtcgaataagtgattgctaagtgggtttcatcaatctttgctgcatcagtgatatccattaattggtcaaatagtaatgtccattgtcctttcgtatcgacacggtacaattgcaattttccatgagtagtcactggtacaataaactgttgtttgttgatccaggttactgaaacaccacgatttttttgttgaaaatcaccgatgatcgtattgccgatggcaaggtcttgttcatttgagaggttgactacttcctttgtttcaaggtccatgagataaagatcttcctgggtaacaaatccataggttaggtcattccccaaaagcagcaattggttgccagataaagcagcaaaagaataagtcccttcaggcagatcagattcaaatgagtgatgctgattcgttgtcagatcatacgcatacagcatacttccataatgccattctcgttcgggtttcgtctctgcggtatagagtagaccttgctctttttccatgattgcttcaagatggatttccagatctgtttcaaaaatagttgctgattctttcgtcgttaataagactttctttacgcgcgtgattttctcagataaaaagcccgcaccatctgcttgatagcctaatttggtcgtcatttttattttaggaaaatcgttttcagcagctttttcttttgacgtatcgtattttttctcagagtcatccactcgttcttttgatttatctgctgagacttgataatagaccgctgtagcatcgtctgtccaaaaataattgctgattccctgctctgctactaagacagaagctcgtccaccgtttaacggcataatcattagttgatttttttctgtttctttctctgtcgacagaaagctcagccatttttcatcgggagaaacttttagctcggtactattttttaattggttgccccatacctgcctttcttttgtctctcgatcaacactgaaaatttctgattgatagcagttcttttcttcgttaaccgtattctcaagataaaagatacggttcccagccgctactggctgtgccacactcttcaactcaaacaacgactctttttttattttcatttacccgcctccaaaattaggataattccattatagcaaaatccgctgacgtgatgtcagcggatttactctttattcttaataggtatatccacgaacgatgccggattcttcaaaaccggcagagaaacccgtttgtcggaaaatcgtctgaccattttctatcaacgtcagcaaaatctccgtactggcactttcccgaataattcgattcatcacaccatccgttggtgccatcaaggaatggccctctttttctgcaacttcaatcgttagttcaagcactttttgcctaacaataatcactaatcgaccttgtttgcgagtcacagaatctaagcgggcaccataatacgttgccaagcgatattctttatcccctatttgtaagactgaaataatccctaaaaaagccgttcctaaaaaaggaatgtctgctgctgagaaaaagaaacggacatcaggtgcctcaaatcgattgcattgtacccatagataggcagcaggaaacgaggttccccagtctttttcgagatacccgattccttcagagaaatcaagtgactgctcattccatagcaaagttcccgagaggctatgagccatacttaaaataccatggtagcattccataaatgaaaggtaggaaaaaggccccataatacttggtgcatagcgactccgagatattggatgaaaggcaccgtaggtcaatgtgcctttaactgataattcagtactctctaatgatagcgaaattccttgttcactaaagtaattctccccgatcttaattaataactggtcttcagcagctgaaaattccgcttcactaaaggggaaataatgggatccttcatggctgatcacttgaataaatggctgttttcttccatccgattcaatcgatagccctggaataaatgcatacacctcatccccaatttgatgtttgaaataccatccttcaaaaaatgcagctttcttcgtattgccatgaaaaaaaagatctgttgtaatcgccatacgttccctccattcagctacaactagtgtagcatgaatggcacaaaagatgggttatgacgttttcaccaatccaggattgtaagatctacgatttttctgttcgtattctcgatcacggcttacttatcttttgcagaacgtctggtccaaaggatataaacagcaaaagctgccacaagcaatgcaatcaacagccctttaaaccgattatcatttgtcaaattctctttggaggcccatcgttgaaggattccaagtataacgaaaatcgttagcataaaggcgacgggataaaagtctttttccttgcgcaagaaaatcaaggcgcaggcagcgactaatagcaccaacattagcaccatatccattggataagataacgtcaccacaaaaaggttaggggtatatagattcagtaaaaccaaaccaccaatccagactatcgctatcacccacaaaaccaaaaatttctttaacttactctgaaaaaaaccttgctttaaataaatcgttttttgcaccccaaagaaaaagaggatgaccaaaacgactgaaaaaacagcagttgtcacataagaataaagatttaactgcaagacactatcagaagaaaagtcattaaacagtttgaccagccatgagacgccgaccataatataaatcaaattcaactgatcgatcaaacggcttttaggtgtgttacgcaacagctcatctgccatttctttaggatttttcccaaaatattcttctgctgtttcaccatgattttgggcttcaagtaaatcattggctatctcatagacttgagcaaccacagcatattcatcttgaaacaggctagaaaaaaataagtactccctcaaatcttcaaaatatttctgattgcttgctgacagttgttttgaaatctcatttgttttgtctcggtaataagctagttgttttttcttattcatgttctcactcctcaataattcgttctactttactcactaggttttcccactgttgtttaaagctgtttaggtactcttctccagcttctgtcaatgaaaaatatttcctgtctggtccatctggtgattttttcagttcagctttgatcaaacgttgtttctccagtttctgaagtaaggggtaaatcgtaccgccaacgatcgtttcaaaaccatatcctctcaattcttgtacaagctcgtacccataaatttctttttttgaaataatctgcaagacacatccatctaagacgccctttaacagttgcgtttctctcacgacattcacctccacgaatcatctcctactagtatgttttacctattagttgatttgagtatatcaaaaagcatctagtatgtaaagcatactagctaaaaaaataaaaacacagtacgtgtaaacatactgtgttttcggttatcttttgattcctcgcccataggaatcattataaggttgaaatgagcgatcgtggagctgggtagcggcatctgccaaccagtgaatatttctaatcaacgctcgtccttgtaaaattaaatccgcttgcttggtttgcagaatgtgttcacataaattagggttatccagcatcccaacggtagccactgggatcttaacagctgctttcatagctgttgcaaaaggtgtttgatacccttcataaaccgggatcgttggctttctatctaacaaaccgcccgtagagatatctaaacaatcaatcccatctgcttcaagccactgtccaatttgttgccattctgtgattgaattttgtttatcctctgtttcataatcggttaacgacaaccgcatccaaagtgacccatcaaagacagctcgaaccgcttgaacaatttctttgacgaaacgatagcggcttgctaatgatccgccatattcatctgtccgctgattcacgattggtgagagaaattgatcaatcaaatatccgtgagctccgtgcaattcaatcatgtctacgccagcagcttgcgcacgtttggctgctgccacaaaggattcttggacacgattgatttcagcaagcgtcatttcgtgaggaacagcatagctttcgttaaagcgaacggcgctaggtgctattgggtaacctgcatccgctgctttgcgcccagcatggttcaactgaagccccactttgctaccgaaaccatgaagcaatgcaacgagttttgataactcaacttgttgcgcttcattccataaaccaagatcattcttggtgattcgtccatctgcttccacagcagttgactcaatgatcagcaagccaactttacttaatgcacgagcaccatagtgaacaaagtgaaatggcgtggcaatcccatcctcttttttcacttcatacatgcacattggtgaaaggacaacacgattctctaacgataaccccgccagttcaactggcgataatagtaatgacatactgacattcctccgctactcattaaattgcattttctgcttgttatcagtatagttgttacacatagaaatacaagcagaaagagtttgtttttttgaacatgaatcaaagaacagtaggcgaatagaccaaaagtcaatttactttgctgaaaactacagtctcccgttagctaagtatggagttagcctttattatttttaaaaacaaaaaagaattgctgattaataattctatcagcaattcttttccctatagttattataaaggaaaaaacgagtaaaaaacagactagtatttttgccgccacctcgtataatgaaacatactctgggaaatggatgtgaaaacagatggaaaagcaacgcatattagagaaacgtcatttatcttttgtttatcaaaaattggtcactcgaaaaaaagccctacgctcttttctggataaaggctacgcaagccatttgcaagacctccaaacaattggcacggatattcgactcaattttgataacttgtcagacagtctggaaacttatgctgccattgagagcaaaaatcgtgaaattgaccaaatgaatctgagtttgcaaacagccgaaaaagaactggcagccgtagaacgtttgctccagtcaccctattccgggaaaatagtcgttgactttcttgatggtgaatccgctgaatccttttatattggcatcaacggctttgcagttgaagatagtcataacttagtctatgattggcgctctccaatcgctgagcttttttataacaatacgttagggaattcttcttaccaagtcaatgaacatgaaattgctgtatctattaaaatagacggcaattaattgtcgctcatgataaactgatccgctttttcgatacttctgtcgcgatccaagatgatgtcttattgaccgcactagaaaagaacgacggcaaaaaaatgcgcgacatcacaacatccatccaaagagagcagaatgcagtcattcgtgaccaatcaagtcaaaccttattggtcaatggagtagccggtagtggaaaaacctaagttattatgcaacgggtcgcttatttattgtatcaataccgtagtcagatcacatctgacaatgtactgatcctttcacccaatcaagattttatccactatatctcagatgtcttgccttcattaggtgaaaagaatcctttaaatcagatgattcgtcaattttgctcgtatttgctgcaagaagcaaatacagttcctttagaaaatgaggaagcctattttttccgtttacaagaacctacttcttttcaaacagaaacgctccgcagcaatgagtttgtggcctttctgcaagaatcagccagcaagacagccctgatcgaaccttcgtttcactcaatccttcgaaagggtaaagtcgttatagccaaagaaaagattcagtcaatctatcaatctacaccacatctccctatgatcgagcgattgcaagcaaccaagaaacgattaataagtgagtgggagtcacaattgatcagaaatgccaaaaagaaccacttgcaagatcaagtattagcactttctgaacagcagcagcaacgatactttggtcatttgatcgaagacgactctccctccagtattcaaaagtatactgaacaattattgcgaacgaggtatcaagtcgttgatgaacaattgaaacagaatagctggatcgatgaggatcaatttttagaacactattatacggcgttcacccaacagccttatctgaaacattctactatcacgttagatgaagcagtaattcgtttattcaaccgacacctatttatcgagaaacttcctgtagcctcgctggcttttttgctgatcgatgaaatccaagattatacacccgctcagtgtacgctgttattgacactatttccccgagcagccttcaccatggttggggatgaaaatcaagcaatttttaattctgcgattgattttagagagattcaagaaatctttgaggctaacaatcgatcagtcacacgctatgacttacgaactagttaccgttccagtggtgaaattactaaattgtttgcaaagcttgccaaccatacaactatgtcgatcatgcctgttcgcccggccggagagcctccccgatttattcgttttgaaaacgagttggaatggctggcaactatcacacctttcataaaaaagggaaggcaatatacgatactgacaaagagccataaggaggctgcttttttggaagaatatctcaaaggacagacaaatcaactcccctttcctgtttattcgattgacatcgctaaaggaagagaatttgatcatgtcattctttatgacgtttcaaacgaacaattctatacaacacaagacaagcgaatattgtatacactgctgtcccgtggcatggaaagtatgctggttacttataaaaaagaacttagtgcctttttctaatccgaaaaccattgattcttgaataaagcccagaatcaaactactgccagatccagcacttaacaactaagtttttttagaaaaaagtacctttttgtctatttgagcaaatgcatctgcccaggcttaggataaatgaagtttcactttatttaccctaagcctttttgacttgtcccttcaacctccgactcttcttcgttgatccgcatccctttgtgataatcttacttgtcttcttctatgatcttaaaaacgtagatgcaaagatttcccatgggatgagaactagacggaataatttcgtcacaacatttgtccaataattgaaattgcagcggtcgtcaaccctggaagctcgtgtcagttgctccaattcaattgttttattcaagcgcggaaggcttttttacataaattttcacaacagtagagcattgaagcccaactgtcagttggaatagttggagcagcgtccgctatttgcagatacaaaaaaaccactaatgacgaatcattagtggttaaatctattgattaacgatgaatgtaagtataaccagatgcattcattgttgctgtgtttggtcctgtaggtgaagggaagcccattccaccttgagagatcgtaatggtgttgcttgaaggatcataagattctacataggctacgtgtccatacgtaccatctgctgtccactctccgccaacggattggcctgcggcaaagacaacaactgctccagcggctggtgttccattcactgtgtatccatcagctgctgctgaggcaccccattgggcaccatttccccagtaagtaccaacccatggtgcgcgatttttaacataccatgtacattgtcctactgcatacatgttacctgatgatgagtggtctttaccactaccaccggtattgactgtagaattattgctgttatttgtatttgatgaagaactgtttgatgaatttgaactattacttgatgaacttgagctgcttgatgatccagcagttgctgtttcaacaacagaagtatctgaagaactttctgtcttcgttgtacttgtttgaacatcttctgtaacagctgctttttcttgtgcttctttcaatgctgctgcctgttttgcttcttctgcttttttagcagccgctgcttcttgttgagctttcaagacacgtgctttttcagcttccgcttcttgttttttcttgttcaacgcatctttgtctttttcagctgttgcttgttcagcagctaaattagctttcaacacattcaagtctgcttgttttgtagccaatgcatctttttgattttgcagctcagcttgagttgctgctacttcttgaattttgctttcattttcttttactttttgttcaacatcttctttgtcgcgtttttgctgctcaactagatcattgttggcatttacgattgttgtcatggcttgtactcgaccaataacatccgtcaaagaatctgcttctagaactgcatcgataaagtttgtgctttgaccatttacttgcacatcgcgtgcttgttttttgatggcttcttcacgttttgcgatacgtaattttaaagtggcaattttatcttgtaatttttctgcttctttacctagtgcaacttgtttagcttctaagtcactgacttttgcactcactgaatcaatttctgcttctagagaatcgatttgtgattgagcatctgcttgttgtccttttagggaatcgattttttgattttgttgttcgatttgatcatcaatggaatctgctgatactaatcctggtcctgcaactgctgttaatgttagagaacacaccattaatgctgataacaaacttttcttcactcgtttttcctccgactagcgctttttgtgtaaattagttgtcttaataaaaaatttacttaatataagaaaatttaaagttcgatttaacgacaaatgaattctaacataagcatatgacatacagataaaagaaatgttacaaaaatgtttcaaagacaattctcatcagaaatattcttctatgctagctataaagcttgataaaacagcatttttaaaatgtttttcaaaaaaagaaatcgataaaaaagcgcttttttatttttcaggtagtccaaaaactcctgaaaaaaccaaaaaatttgcttttttacagtgtgaatccccttttttctctcttttggccctctctttatccgtttcttttttcattaaagaagataccgtgtaagcaaaatacttgatcctttctaagtgacaagcaagttttctcttcctataataggaagaataccgctcgaaaggaggaagcatcatttccaaaagaaaaataattatctggatcagtagcattttggtttgcggcttacttttgcttgctctttggacgaccaaaaaagcgaacagtgtgttgcagcaagattcagaaagcgaattttggctgctaagcgatgttcatttcctgtcgtcagcacttcacgataatagtatagccttcaaccagtttgctgaaggtgccgctggtaaagaaatgcgctatcaggcagaaagtttggaagcttttgttgctgaagccctagaaaaacgaccaacaggagtgatcttgacaggggacatgacattgaatggagagaaagcaagtgcagaatctcttgccgagttattggcaccattacaagaagcttcgatcatggtactgagtttgcccggcaatcatgagatttacaatggttgggccagaatttttgatggggataaggaattttatgccgatcaaatcagcccgcaagatttcaaagatattttttccgaaggctacgagaaagctgacagtgttgatcggacctcattaagctatagcatcaatctcaatgatcagtatcgcttagtattacttgattcatgtatttatgaagaacaagtgaattggaaccagccaactacgaatggccgcttgaaagaaagcaccttagaatggctgaaggatcaactagaagcagctaaacaacagcagcagacaccgcttctcttcatgcaccataatcttctggaacataattcattgttgaaagaaggttatattttagataactcggcgcaattgcagcaattactaactgcttatcaggtaccagcgattttttctggacacatccatatccaagatattacagaaggaccctctggtattcaggaaattgtcaccggctcttattccacacaagaacttggctatggggtcgtaacacttactgataaaacgatcaactacgaaaaaaaggtgattgatttggaccaatgggctgctaagaacaagcggaaagatcctcaccttttgcagtatagcaactatcaagcaaccatctttcaacaagatacaactaaaatggtgcgccaacagctcgcatctgttactgaattgacagaagaacaaatcaacacattatatacatttattgcaaagatgaatgcagcgttatttactggtgacgacgtttattcgcaagaagaaaaagaaacgattcgacattctgaagaataccagctgctggcaacatattcttattttctaaaacaatatgttgactcgctattggaagataagagtccagataatgcgctgacacttcccataaaatgaacgatagccttcctgtcataagacgggaaggctatctaacgatgcaatatttattctttgaaagttgaagcagactattactactattatttatttctcatttaaacgatgcaatccctaacctctactgcatccttgtaactctgaagttacgccagttttgaataaatttcctaaaaacaagataacgttggtacaaaaatatttctcgtattcaatcagtataacacattttggcaaaaatgtcgtcaacagacttcctctctccattcttgtgtagatttagcttggtattctttccttaacaggcaacatcacttcaaaaatctgctgttctttttgatccgtggatacatcatcttgccacatcagttcccagatatctccatctatctgtaaattagctgattccagataggctttgaatcgttttgtaaaatcttttaaatgatggatctcccctctgacgaatcccgacacataatttcctgctggtctacaaataattgcttgatccgagtaaagaggcagtcgttctttgggaatcatcactaatgcacggtaaggcgcttcatggatcgactcttgatcgaatgcagatccttctactaaataaccgatggggtagccactaaataaatccttgtaatctaaataaggataaaaacgtgaaaaagcctgaaagaccgaagtctcatcatactcattgatttcttcagaaacagcaaaatatacttctgaccgataactataagtcatattggtaaaatcggctgtctgtactttttcaaatcgcgaaatgaaccgatccaaaacggctttatgttcctctagttccgttattttctgatctacttctttacgacggatgatcaactctttttgcatcgtctcaggattgcggtttcttagaaatgtttggatttcctctaaggacatatccaatgctcgcaagaccaaaatcacatctaattccgcacactgttcaaatccgtaataacgatacccgttttcaccgatctgtttaggtttgaacagcccgatttgatcataataaagcagtgtacgacgactaacaccgccataagccgcaagttcactgatggtcaaaaattttttcaaaaaaaatgcctccctcctattgactgttacgttacgttacagtttattctagcacagaacgacgtaattggagggaatttttatgaaacaattaaaacaattttttttcaccgaaaaacgcctatttctaggtacttttttatttatgctgatccattctttcgggacactttttcttccctattttgtagccaagatcattgatgatggcattttaaaacaagatcaatcagctatcatccgctatgggggctggatgctggctgttgcactaggaactggtgtgattgctgtcagtgctagttatttttctgcccatctagcagggaaattcggacatcatcttcggatcaaactattcaacaaaatacaggagcttgcgatctctagttttgaaaaatatggtacaccaaccttgcttgcaagaacaacgaatgacatcaataacattcaacaaatcttgatgatggctttacaaatgattcttcccgctccactgatcattttggcttcgattattttaacaggtagtgtatcttggcgaatggtgtggatccctattgcagcgattgcttgtttctcgatcgtcgcacttttcgtcatttatcaagcaatccctttggcaaagaaaacgcagaaaaaagtagatactatgatgcggattttgcgtgaaacctatacaggcgtacgggtgattcgcgcctttgacaaagctagtttcgaaaaaaagcggacagaccaaacctttgaagggtacgcaaaagtgatgatccaagtcaatcgtttattcgctgttttgaatccagccgtacactttttcatggggctgtccattctaagcattttgggattcggcggtttccaaagtctctcaggaaacctgcccatcggcagtatcactgcgatcatcgaatataccgttttgagcctttggtttttgaccatggcagcaatggtgatcgtcatgatcccaaaaggattgacatccttgcagcggattgaagaagttttgtctgaagaagaaacgatggcagacggtccacagccaatcttgccaaaagaaagctcattagtagctgcctttcatcatgtctccttcacctatgctggggcagtggaacccgtactggaagatattgattttgagatccatcgcggacagaccactgcgattgttggcggcaccggatcaggaaaaagtacgatcgccaaagcacttttgcggttaaaagacgtttctaacggctcaatcacattatatgatcgtgatattcgagaagtctcacaggtcgcactacgatcatttatcagctatgttcctcaaaaagcattgttgatcagtggatcgatctgggacacattgactttcgggattgtcaatcccgatccgcaacaagtagcacaggccgtcaaaatcgcgcaagcagagtcgtttatcaaaagtctacccgatgggatcgacagtcacgttgctcaaaagggcagcaatttttctggcggccaaaaacaacgcttgagtatagcgcgcgcattagtgaagcccgctcacatttacttttttgatgacagtttttcggcgcttgactatcaaacagatgcaaatttacggcgagcattaaaatcttatgtccgtgattcagccgtagtgatcgtggctcagcgtgttgcaactgtcatggatgctgatcaaatcatcgttcttgatgaaggaaaaatcgtcggaaaagggacccactcagaactgatggaaacctgtagcacctatcaagaatttgcggcttcgcaaggaataggaggagaaaaaaatgagcaaaaaaataactgatgcaccaaaaaatttaaaacatacgagcatgcggctcttacaattattattccagcaaaaaagccgcttcggactgattttgatttctgctctctgctacgcgacacttatgacaatcgcaccattactgttgggtcaaggattggataatctcatcactttgcttcagcaaggaggctggcaaccaagtgaattcttgcaagtcatcaaatggccactgctccttctagggatctcctggctgatgattagtctattttcatttttacaagaatacacaatggcaagtgtcagcgaaacattgaccttaacccacagaaaagaattgacgcacaagtttaatcggttgccggtacgattttacgatacgcatcagacaggcgatattttaagccgagcaattctagacctggataaagtctctgaagtccttcaagtcggattgatgcaactcattacagccactctcagtatcttatttggtcttggtgtgatgttttggctcagtccattattaactgtagggattatcattatcctactgataagtgctttcgctacccatcgactggctcagcgaaatttggtttacttttcagaaaatcagacaacattgggagcagtcggtagccgggcagaagagttttatactgcccatttattgatcaaatcctacaatcagcaatctgctgtcgcttcagaaatgcacgaattaagtgaaaagcaatttcatgcttttcgtaaagcacaatttgctagctatgcgatcaatccgttcattcgctttatcaaccaaatcgggtttgtcgtaagtgctgtgattggtggaatgatggtaatcaatggacagttatccatcgggttgatccaagcctacttgcaatataccaatcaagtttccgaaccgatcacacaagcttcttatattattaatacgttacaaagtgcattagcgtcattggaacggatctttgagattttggattatccagaagaaaaagaaacccaacaccctcttgcagtcccagaagaattgtcggggagaatcgattttgaagatgtttctttcggttattctccagataaattattgatgcaacatgtgaacctacaagttgcacctagacagacagtagccatcgtggggcctactggggccggcaagacaactttgatcaacttgctgatgcgcttctatccactgaatggaggcaagatccggatcgatcgctacaatatgacggatttttcagccacagacattcgcaaaaaatttgggatggttttacaagacacatggttgtttgaaggaacgattgcagagaatattgcttacggcaaaaaagatgcaacgaaagaggcaatcattgccgccgcaaaagcagcacaatgcgatcattttattcggacactgccgaagggctacgagacgatcataggatccgaaaccgaactatcacaaggtcagcaacaacttttgacgattgctcgtgcaattttggcagatccagctattttgattctggacgaagcgacttccagtgttgatacccgaaccgaacaaatgatccaaacagcaatggacacattgacgaaaaatcgaacaagctttgtcattgcccatcgcctctccacgatcaagaatgctgatttgatccttgtgatggaagcaggacaaatcattgagcaaggcgaacatgaggaactgttagcaaaaccttcattatacgcccaactctacaatagtcagtttgccagaaattgattagaatttttgtcacgtttcatctagagatcaaaaagcgaaggccatcgccaacaaaaaagactgcgtctagtatacagacgcagtctttttttgagattcattgactcatttcttcatttttccttggagatcaccaggtcaagaaagtaatttccggaaatgaattttttactttaaagcaaaaaaagaagaccattgccggtcttcttttaaaagttgttattatgctttaacgatgtttgttgcttgtaagccacgttggccttcttcaacgtcgaaagtcactgcttgaccttcatctaaagttttgaagccgtcgccttggatagctgaaaagtgtgcaaatacatcattgccatcttcacctgtaataaatccaaaacctttatctgcattaaaccattttactgtaccgttattcataaacgtatacctccatattacacatcgtgtgtgtttatttttgtaatagaaaatgatgtgtaattgaagtgcgtatcaaaagataaacaagtattaacatatcagaactttacttttatagaataccatgccagaagaaaaatagcaatgataatgctgcttttctttttcgatactcgtaaaaccttaagttttccttggcaacaacttttctaatcctgtctctagctcttttaccaccttattcctttcacatatcctttgcgctttgtagaatatttgtagaacacgcgacgcttttgcgtacataagaacatgtaaaatagcgaattctaagacagtgctatctaggctatggtttcaagtacaagattcaacgccaatcgatacttgcctcttgcagaaacatgcaccgaacaattcttttattttatcaaacttgtctctggaaactttaaggaaatttttagccttctttttattctagttctatttaaaattatttaaaagtaaaattatttaaaagttagtagagaaaatccccaatgactcgctgaaacgtaaattgattcatagatgtccttctcatccctgtaaagataatttccattaaagctaccttactcataaatttttctttcttgaaactggattatgatattttcagtaagaattgcttgatatttattaaatttctcctcatttatgttttttgtttcacaaactaaacccctctatggtataatcattttgtttttaagaaaactatgggcatacaaaggagaaggtaacatgaaaaaaacaaaaatcactttaatcgctgcttcattgctaatgggaggaactcttctagctgcatgtagttctgataacaatacaactgcaagttcatcaactgctgcttcaactgcaacaactgcatcaacagatgatgttgtttcaacagcttcagtaagtgaccaaacttcagtcattgaaaaagcattgagcgcagacggtaactggatcgttgctgttacagacaacatgactttcgacaaagatttgacagttgacggcgaattccatgacaaaggggacgctgcaaatgatatctaccgtaaatttgcattgtactctcaagatgaaaaccgtacagtaactgctgaatacactgtaactgttcctaaattagttgttaactcagaaaacttcaacatcgttaacggtgtagtgaaaggcgacatcgaagtaaatgcaaaaggcttcgtattgaacggcactaaagttgaaggaaacatcacgttcgcttctaaagaaattcaagattcagcaacacttgataaagaaggcgcatctgttacaggtgacgtgaaagtcagcgaataattttttactgttttctttgtgaaaaacactttcgaaaaaggaaccttggatttgattttattcatctccaaggttttttctgtgtttttttattctctgttttatcgttgttcccactaactttgtgtaagtagctacaaagattttctgataatctaaaaaattcctcccatcgtttttcactctgacgcacacttgccaaaaatgtttgacgataagaggattttttacttcttgccgattaactgcttaattcaatgctactcactcttcaatagaagcccatttgtaatcatattgcgcacctgcaccatgagaaacgactcctttgacttttggcgcccgcaaatgggcttccacgttttggtaaacaggaatgacaccttgttctgccataatgattttttctgcttctagtagatcttgccaacgagcttcaggatctcccgcatgggttgaagcagcggcattcactgctgcatcataatctggattactccaacgaccacggttataggaatttccagtaacaaacagatctgtaaagctgctggcatctgcatagtcggccccccatccgcccattacaacatcaaagtctccgttgttggaacgatctagccgaacagaaaaaggtaccggactcaagctgactttcacaccatccaatgtactttcgattgcactttggacatactcgatcgcttttttagtcgagtcggtatcagaagccaagatttcaaaatctaatgaatcgattcctaaagctgctttggctttttcccagtgttctttcgctttgtcttcattgtattcgatcacactgccagcatcttcaacaaaatctttgttatccgtcgggctgaaagtcataccttctggaatcaatcctgtcgaagctagagatccgtcccccagaatggaggatacaagtgcatcacgatcgattgcataagaaattgcttttcgcaaatcttcattacggaatggagaattttcttctcgctgattcaattcgatataagaggtccgggccaaaggctctgaaacgaaagcttcatcatttgccatttgctgcgccaattctcctgttaagatcacatcgtctgcttgaccatcttggaatagattcaacgatgtcgcagattctttgacaacactgacattgatggtttgtaatttaacattttcttggtcccaatactgatcattcttttcgtaggaccattccgtatctgtacccggtccatcaaatcctgtcaaaacaaatgggccattgtacacagaattatcactggtcgttgcatattgatcgcctttttcttccacaattccttgattttgcgggaagaaagatgggaaagcgagtaaataatcaaaatagggggttgctttttctaaagtaatctctaattcgtactcactgactgctttgatccctaactcgctaggatctgtttttcctgcagtgatcgattcagcattcttgactggggcaaacaaataagcgtattctgaacctgtttcggcttttactgtccgttgccagccgtaaacataatccgcagctgttacaggatcaccattcgaccacttagcatcttctcgcaatttcaatcggtagatcaatccatcttcactcacttctgcgagttcagcagctccagcaggttgcggcttactgtcagcatccaaacgatacaatccttcatagacattattcaatgcactgaagctgatcgtatcagttgcaagagaaagatctgcactaggcatttcttgctggacgacaacattgaagatctgttccgctgctgctgttccattcgaggaagtactttctcctgtgttactcgtgcctcctgtcgtacatccggctaataagacaccacacactgctaccaatccaaaggcccactttttcattttcctcttccccttaagttcataattttcagaattttctgaagttgaatttgattttaatcaataattatgataattgcaagagtttttcgctcgtttttttcaaaaaagattaaaaaaaaattctttttttcataaataattaatctacaacctttatgttctctttcaaacaagaaaaaactgtgatacgcaagagcatcctatcagctccttacgtatcacagtcaaacaattatcaagcttccattttgtagctttctctactattcttacgatctcttatcacactaagaatcgtagggatcgcaccaattgcagtaaacagatagacaagagctaggttcccatagtattgactagcttccaaataaccttctcttagcaagtcaggcaatatccgaaatgcatagaaataatcaacatcggtataataattggctacactgatagaccaatcaatccgattgcctagataaaccatgatgaccataatcaaaacactaccgatgatgcctttgttgctcagctttccgccaagaagttcatacccttttaaagcacagccagccattgcaatacctgataatgccgctacataacctaattggccaagtaaaataatgacaccgaccccaatcagtgaacctataaatgcaccaactatcccagccagccagttttctttcttctgattctgctcatgcaggctagcaagcatcgcttcattttgctttttgaaacaagcactgcaagcgatcactggcagcccacctatgctgtaggtatctatcggcgcttccgatgttccgcaaaactgacagactgtttgatagtgattttctttaagaaaatcagtgactgtatctagaccagcaaccaatttttctttggttttggcaacagtcattgcccctcggaatgtataagtgacttggtaaccttgtacagagcagtccaatatgtctttggaatcagtcactacttgtctcacttgctctgagctaggtagttcttggtttttgctgatcgaaaaagttgctgcgaaagaataactattattattcaattgtgtcaatataactttatacgaacgatacgtaccgtaaatcacacccatttttggatctaccgacaaccccaacgtctccgcaaaactagataatgtttttacgagcttcttattcatttgtcctccttttaaacgatagattataacaaacgttataactttgagtgtaaaatagaggccaaaatcgtgtcaaaagatacgtttgtgtattttgtaacacgatttgttttctttaagcgattcccgatattaccatctgctggccttcaggaagtgatcgataagacaaatttctgaagagcagctgcaactccactgtctttatttgaaagtgtaacggcatccgcctgttccctgactcttcgtggtgcattggccattgcgacccctactccagcttttagtatcataggtaaatcattgaagttatctcctattgccaacgtttgcgctagaggcacgttgtaataagaagccagttccatcaatgctttttcttttgaaacttctcgatgcgtgacttctaggtaattatcttttgaaaggtaaagagcgctcgtcttcaaagattgcttttcccagtaaccttttactttttggatctcagcagacgtaccgatcaaaagtaatttatgaacgggtatttgcaaggactgtactaaggccaataaatctgcctcctgcgctacctcctgcgtgattgtggcttctttttttacccattcatcaagacgatccacataccaaactgtatctgaataaagattgatagaaacttgtgagaagtgtgttcttgtctcgctgatgattcgcacaacttctttgatggcaacttcatgacttgagataggcggagcagaaagatttccgtttgccagaactaacgcgccattgtaacaagtcaaaggatactcgctgattcctaacgcttcagctaagtgctgcatcccttttggtgatcgtgcagacgctaagacaaaaggaattttactttcttttaatcgttgcagcacctgttgtaagtttgggtcaatctgatgggtatcatctaaaatcgttccatcaatgtcgcttacgattaatttgatttctctcgtattcatttgtgcctcctaactttagctatgactttcattcgactatcttcatcctcaaattcgcctaaggatgaatccaattagcgtgattttttgattcgtaatgcttgattcttcgctaaataaaatggacgcaaataagcgactgtgtttgataaaagtagaacatcgggagatagttggatgttcaagcagttttcgagatattctttgcgtttcgtgatacgttcccacagttctggataatcggcttttaattcttgtcgcagttcttgatcagctaatgcaatacattcttccgcactgacaccagtatactcaggaacagatggaatgatatctacttggaacatcatgccgctttctaaaggtgtaagagagtccgcgtagattggtgaagacatccactcatcatccgaaaccagatgtccaggattcaagtgccagtgataactcttttttggcagaacttcttcaatcaatcgatacatctcgccacccgtttggttgattcgaattgcttccaaccaagtggtgatcgcctggtaatacggtttcacgacacgttcaaggtaatcttgttgttcagccggcaattgacttgcttctgagacgacaaatcccgtgcgactggagagtcctcctttataaccaatcgtcattgagaaaggatcacccaaagcaattcgtttgtgcgttggataaagattggcaaattcaaatcgtttaccgctagcagcgattggcaccacagaaggcatttgtccctctgccaacaaatatgccccaatttcggcttcttttttgccaacttcaatcgcattcatcgcactcaaaatacaacgagaagaaaggttagccccatattcataatgagcgatctcattggcattgttgtgactacggcttcctttttcaccaatcagcaaataagcagcatttaccacatgacatgtccttgtgactgcccgtttgactgcatctacgataaaataaggaacatcaaagagtgtggctggatcttcgtgatgcgtcgtgaacatcttccacccaatgatgccaatttttttcttctctttaaaccttaaagaagaaaaaacagaggatagtgatttttctcctgtcataggctgattcggcagcgaaaactgcgggtaatggactagctctgccgctatgcgggaatgagcctgcagctttaaattttcatttcccaaaatgagtgttgcggcgccagttttatctagaaccaatagtccttcctcgaatcttggcaggaatcctgacagatattcaaagttgctgccatgttctttgtctgcatagatcaccaacgtgtcaaactcttcagcagccattcgctctaagacacttagtttgcgctgactcatggtcgcatcacttaaaaaaactggagcgacctcttcaaaaataggtggttctggtaaaatggctaattcaatcgcttttttcatgattaagactccttctgatttactctgttacataaatggtcacattcgctgcggcaagtgctgcttgtaactcgatgtctggttgttgatcggtgattaaaagatcgatctccggcagatcacagactttaaaaaaaccagtcgttgctaactttgtatggtcagctactgcaatgacatactctccttgtttcaccatctgacgcttgaccatgccttcttcttccgtatggataaatacgccttctgtagaaagggcaaatactcctaacagtgtgtaatctgcctgaaattgggcaagtttggcaacagtatccgcaccatataaaaataattgttctttgtctaatcttccaggcaaaaccgtaatcgtactctgttttagcgctgccaatcgttgggcatgagtcaatgaattagtaatcgcttgaagaggataatctgacagttcattgatcaccgcttctacagttgtcgatgcatcaaaaataatcgcagctggctgtttgatccaatgaatagctgctttagcaatttttgcttttatgtcataaaattgcccggcgcgagtttgataatcataaatcacggctgcagggttcgtcgaaaccgcccctccgtgggttcgtttaagtacttgccgtttttctaattgaatcagatcacgacgaatcgtatcttttgatacggataacaacttggacaatcgttcaatcgaagcactttgctcaactgctagcacttcttggattttagctaggcgctgttccacaaacatctctctgtcattcctttccactaaaaaatacaatgcaaaaaattgctaaacaatgcaaaaagatgcaaacgatcttaaaaaaactacctccaacaaacatgttgcaggtagttttgtcgtcattgttcttcttattttacacgaagcgcaaagctggctgttgaaaaacctgaacttgcttcggtaaccgtgtacccagtgcttggtgcatgaatgaagctgccgttaccagttgcaattgcaacatgatacgtattgcctttttcaccccagaatagaagatctcctgcttgggcttgagatacagggatgatcgtaccggcactttcttgcggaacggtccaatcgccaatatttttccctgttacttgtaaaaagacataacgagtgaaaccggaacagtcaaagacatctggccctttccctccccattggtagggtgtcccgatatatttacgggcttcagctacaatagcagcaccgttaatattcgtaccgatagtattgttgccagaattgccaggatttgttgtggtatttccactgacttcttttacgtaagctgccgtgatccagccaccgctagataacttataccacgtcgtattaccattgacagaagtcccttttttctgcgccactgctttcactacagcgttgctgctcaaactgctgacaatactggcagtagttgaagcgttcgaacgaacattcatcccagtcgtagtctgtagatttttactgattgcttgttcggcagaattatttgatgaattagaattattgctgcttgatccaccggttgatggactgctcgtattgctcgcatctttgacataagctgccgtgatccaaccacctgtagataatttgtaccatgtcttattgccgttgacggatgaacctgatttttgagcgacaactttaacggtcgtgctattgctcagacttcccacaacactaccacttgttgatgcactggaacgtacattcaatgaagcggtggtcttgacatttttgctgattgcttgttctgtagttgatgtgtttccaggattgcttgtcgttgaaccgctagacacagcctgaacataagctgcggtaatccagccaccattagacaatttgtaccatgttgttgtaccattcacggaagttcctgatttttgagcaaccacaatgaccgtggcattgctgctcaatccccgaacgacactcgcactggttgatgcactagaccgtacattcagtgctgctgttgttttgacggtcttattgacagctgtttctccgctagtactgttgttggaagagttgctgttgctggcggttgttacataagcgccagagatccagcccccagatgacaacttgtaccacgttgtgttcccattgacggaagttcctgatttttgagcaacagctttgatcgtggtattgttccccacaccgttgataattctcgcactggttgaagcgtctgaacgcacattcagtgaagcggtcgttttaaattgtcgattgatcgttgtttctgacgatcgagcaagagttgtcgttgcagttgatttagttgactttgctacttctgtttcatttactcctgtagcgttggcctctggtgcgttgaccaaagttgtgaatacacctgatgtagaagctaacaccgttgtaacccctatacttttttgaataaaaagtgatcgtttttgtttcactaaacgcttacggattgcttttcgagattccaatgaaacaccccctccttttcattctatcaaaatcgattgatttttaacatcttttttctgtctgtaacatttatttaatgtaggtttattccttggcaccgaaaaattttctttctaaacccacgttttacctatacaaacgatacaaatacaattctattttaaatgaaaaaaatatagaacgctatcaaaacgaatgaacccgactgtttttttggaaactagagtagctcctatcaaataaacaaggtaggccaattttcttcaataatcctgccatctactcgacatttatttgcaatctagtccttttttcttcacaaatactattttaaaaagcgttaaagctttaaaaacaaaagagaaaccgttttaattctttgtgaaattatgctatagtaaaaaaaaggaagaggtgacttaaaatgaaaacgaaatcgaaagaaaaagtttatgccgagcgtcagcatagttataagcaagaaaaagaggaaattttcaaaaaagcccttgcttctgtaccaaaaaaagacaaaaaatccgccgctaaagacaaacgatgacccttatctgcctgcgacatttactttaggctgctttgtagcttgaaaaacatgcctgactattcaaccgatccgagtagactctcggttcggctaaataatcaggtattttttgtgtcgttaaagctttaaagatcccgtcattcctttgacaaaccctcgttgcataaagagaaaaaggactaatgtagggatcgttgcaatgacaattgctgtcatctgcacgccatagttcgcaacataagaagccgatgataagttcgatatcagcaacgtcatcgtttgacgatcttctgtctgcaaaaagatcagcgggagcaaatagctattccatgagttcataaaagcatagatagccgctgctgcataagttgagcgcatcattggaaaaacgatccgaaagaaaatcgtatactcacttgctccttcgatcctgctggcatctaaaatgccatcgggaaaggacttgaaattttgacgaaagaaaaaaatcaggaagagattattgactagcggcaaaataacggcgatatgctgatttacaagatgcaggcctgacatcatcttaaacaatgggatgactaatgcagccagtggaatcatcatgcacagtaaaaaaagcgagtaaatcatttcactgctgcgggttcgaaatttctcaaaaccaaatgccgccaatgatgtgatcagtaaactaaatagaacagtaattacagaaatcttgatcgaattccacatgatcaaggaaacattatagttagaaaatagttgctgaaggttcgtgatcagctgatttcctagtgtgagttttccagcagcaatctgattcgatgtattcgtcgctcccgcgatcatccaatagaaaggaaagatagagacgaatgccgctacgatcaaaaaaagatattttatcagtgtattcacatttcgcttcatcgctgctcctttctgcttattgtcggtcgtcttttgctaatttgaactgcgcataggataagaccgcaatgagcactaccaacgcccacgacaatgttgctgaataaccaaaatttgaggtatagacaaatgaatgattgtagatcagttgtgctgcagtcaatgtcgcatttgaagggccaccgcctgttaaattcaccacttcatcaaagagctgaatcgttccgatcgtcgatgtgattgtggtaaaaacaatcactggcttcaattgaggaataatgatcctaaagaacttctgaaagctgtttgcgccatctatatccgcagcctccaacgtatcatctgaaatattttgtaatcctgctaaataaaaaatcatgttataccctgtccagcgccagcataaggcaatgatcaccgtcactttcgcccaaaaagggctatttaaccagtctaacggttgttggataattccaattgccagcaagccccgattaatgatcccaccgatctggaacatcatcttaaacaaaaccgcataagaaaccagagaggtgacacttggcagaaataaggcaagcttaaaaaaagttcgtccaactagttttggtgtattcaacacaaaagctagtaaaagtcctaaaaacaccatgattggcacttgaaaaatcaagaaaacaaaattgttgaataatgctttgtggaaaatggtatcttgaaacatccgaacgtaattgcctaaaccaacaaaaacggattgcaatccttgcatcgtatgaagagataaataaattgaataaagaattggatagatcatgaaaatactgcttaagatcattgcaaaactaataaatttccatacttctcgcctttttctcgaaggatccatcttattcactccctgctaatgcaaatcggctactcgccgacttgcattgtataattattttcggcttcttctagcatttcgtccaaactcaatgcatcatcaaaataactctgcataactcctcgaagagcatcaaccgctgcttgcgtattgttgccatagtcgacaccagggatttcagccatccaactcgaaaaatctttatagatgggcgcatcattgaaaaatgggtctttgtattgatacgcatcccctttttgagatggtaaatacgttcccactgccccattctcgaccaatatctcttgataaaattcatcattgcctgcaaattctgtcttcaagaaatccattgccagttctttatttggcgaatcgttcaaaactaaccagcttgatccgcctaggtttgaatagggggtcgccccatcaactgtctctaattgtggcagatgtgtataagcccacttgcctttttgatcctccgcggaacgaatcgttgctgaaaaccaaatggcagaattaaccgccgcgacttcaccactcgtaactgctccgattccctcaggagcaaaataatctaccggttttgctaactctttctggtcaatctcttttaggatcggcatcatttcgcggatcgctggattgtctttcaagaaaattttgccctcttcatcgaaataccacagtccggcagactgcatcgccatctgcagataatgggtcccacggttgggaatgaatgcgacaaaccatttaccggtcttttctttcacatcttcaccgatagtgacaaattgggaccaagtcaaatctttcatatcttcttcactgtagcctgcctcacttaaataatcggtgcgataatataatccggcagaaccagaatcaaatgggactgcatagattccctccttataggtagcattctctactttgtattcggcaaaatcagcaaagtcgatggtatcagataactccgcaaatttcccttcataattcgtaagataactttgtacatcataatcatccatcaaaacgatatcaggcaatccttctgatacccccgacgtgaatccagaaaccattttttgctttgtgtcctcattcgacatttcgatgacattcactttaatctcatcatgcccatccttacggtagtactcccctgctttttccataattggaatattgaaattcgtatcccaagcccagacagtcaatgtctgctcatctgaactagcaaaatctcctgattcactactctcattattactggaacaaccaacaagcaacgcaaagctcaatatactatatagaaaaatcaacctttttttcatttttctctcctcctatttgcttttcctaaaatcccagcaaaggtgcaatagaaagcgattgcaccttgcttttattatagatatcagatgaaaaaaaccaaataattgaatttctgttgataaaaatgaataaatttgagccatgatgaatggaaacaaaatatgaaagaagtgcagaacaatgagattaaaatgagaaaatgatatagtagtgctaacatacaggaggtgagcagatggtttttacgattattctaaaattattctttgggttatttggcttattgttggtggcaagactgttagggaaaaagacactgtcggaaatcacacctttcgacttgatttatactctcgttttaggcggaattttagaagagtcgatctacgatgacaacgtttcggtcttccatgtccttttcgctatcgctttgtgggcactgttgatttactttattgaagaatttgttaaaaaaaatgagacaatcaatcgctggttgaaaggcgaaccggcagtcttgattcacaatggtcagctcaatatacaagagattacccgcaatcatatcgaaatggagcagttgcgaaccatgttacggcaacaacaatgtttctcccttgcaaatgccaagtatgttgtactggaaaacgcggggcaaatcagtgttttaacacattcagaggatgagcaaacattggcaatcatgctggttgaccaaggaaatattcaatatcctgtactgcaatcccatcatttgagcgaaacttggctacgagaagaattacagaaacaaggctattcttctttcaaaaatcttatttatgtagagtggtcccaagacaatgggttttatatcatcaccaaggcagagacgatccaggctcgctaccgaatcgatggctaaaacaatcattcgattttaagatacttttcctctttaggaagatgccatcaggaagataccatccatcaaacaactattttcgacgagtaatcacttagcaatcagcatgagcaaaaaagacttactttaaaaacgttattttttcctcactgcctcttcatagagatttctttgttttcttggaattttttcagatgaaagaagtattctactgaattagatggaggtgaagggatatagaggtaattggtggattgattttttggattcctgttttattgtttcttattatcggatcgatatttattacatggcgaaagaatgtcgttgtactactctttcttttgataccatttttgttttttttactaaatgtttttgatcatcatcattatgaacccatgtctgatttgatgtacaatcttttaggactagctctttcaacgattgctatcatcttttatttgctttttcaaagcaaaaagaaatagagtctatgccataagatcttcgacaaacggatatcccatcggtgacgatgtcccgttgtactccagtcgaatcttgtaacaaaagagcgatgattcaacgatcaatcagatgttttttatttttactaagattaaataagtgaacgaatactcactcaaataaaagatatcccaacaatgagaaatagttagcccgtcttcacgattttatcgcgagtattggctagctactcttaggcgggatatcttttttcgcttgaatcttcttatacaaagcagaactcaattttttcactagggccttagctattgctataattgcaggcaactagtccacttgttcgatagtcgttgtcccccagttcatgacatttgcaacatggacatacccatcataaagatttaacagcaaagcgattgcacagacaatataaacaagtcgataaaaagaatttgtcttcttgttgcgccaaatggcaaaaccgcttaggaggatgcctaaaggaaagatgaatgaggatacgccggctaaaagcagcaaaatcaatccttcatctttatcagaagacatttgttgggtgataaaactcaacttcttctttttatcttcaatttccacattattcttttgaatttgttctttcaattgttcattttcctgcagcaattcatcaatcgatacttgataaagtttgcttagtaaaactaaattatcaatatctggatagccacgcccattctcccacttagagatcgactgacgagaaatctttaattcttctgctacggaagcttgcgacaatccgcttttctcacgatataattttagttgttccgctaaggccactaatttcatctcctacacctattactttacaactagtttaccattagaaatggttgcggtcacgcttgcatttgttgtaatcgttccagctttttgtttaaagctgcaagtagccttagtagtcgtatgggttaatgaactcgaaagaatacttcctttcaatgctttgatgctcaaatttgtcgccgctgtgatctgttcttttgagttgatctttacattataagaagcagtccaacttcctttgactgtcttagacactttataagttccttgagcaattcgtgcaaagggttgaatatattcaacagatagtacgacttcatcacccgcttcatcaatataagatatctcttgagaaccgacgccagcggtcatttcataaacaagctcatctgtattcttttcatccgctgcagctgtgacagacacccccaaaaaacctaaaaaacaggctactaaaataactaatttcttcataaaaacactcctctcttatttgttttcactttatcgcttttcttgaaatataaggagaaactataggtttacagggggaaaccattggtttacatccttcatttccctttcattgtaaacaaaaggttgcttcttttctataacaattactgtaataatggaaaagtacgatctgtggggaggtgtcagaatgaaaaggcaaaataaaatcctattattcagttttagtctgccgctttttagtgtttttttcggtccagtatctagccaacaatttggtcccttgtacgaatatgcttttggcttcccgctaagattcatctggtataggagtatcaatgaacctcttgaaagtcattgggcactcttttcctttgaaaagatcgctcacttgcaagttgatttacttggctactttcttgcagtgctgctgacttatctcgtttcccgatttttgttcgagcaactctcacaatggctgcataagcatgtgcaaagcggactattataaataaaaggaatgttttcgttaagaggataaaccctttctcaatccacaaagacaatacgacctcaagatgtcgtaggcgaaaacaagttccccctatatattgtggataaaactgttaatatgtgcataactcggtctttgacacgctgttttacgaataaaacggcccaacaagtatccttttcacagataaatgttgggctggtatcttaactcatcctcattttccagcagaccttcgcaaaaaattttttgccttgctgctaaacttatttttgttattcgtcattctcgtgctatccatcgatctctttcagtgctgctgacggcacgtcttctttggcaatttcttcatacgtctcaacatgtgcccctttattcgtcaatttcaaaaagcgctctgtcttcaacacttgtaagccttcaaattctatcattcgagtctggccatctgccgtggcagctacttgtttgtaatgagcagtgccatagccgttgaccgattcaggcgcttgcgtttttacatacatttcgctttttggaacaagtggattcaattgatctaaaattcctgccacctctcccgatgctcggttagtgtacaacatgattcccccgcacagaagtaagaaaaacaaaccaattgataagattgctcgtacgatttttttcatcatattctcctttcgtctctctttctatcttagcaaaataaaaacaggggaaatcggccttaggtcccaatccaaaataacaaaattgaaaggttgccgtaagaaaacttctacaacttattgatatttgcttaatactgcttatccagctaggcaacaaaggcaaaaaagattacaataattaaaaaaaggagtacctatatgcttacacatttcaatcttattgctattcttttggcaacacttgcttttatgatcagcgggagcttactttataatccaatccatgcttgggggcgcttttgggcaaaagaatctggcatgctaaataaagaaagtcatcatatgtctgccggcgatgtcgtttttacttttggcgggacagctgttggcggactattattggcatttacactaggacaagtcacctattggttcaatacgtttgaccatgacggttggatgatgacgagcttgcaagtggcctttttgctatggctgggcgtatttgctgtggcaactttcgtaaatgcagcctatgctggacaaagcaaaaaactgattggtctgcatttattgaatggtgcaatcgagttagtcattatgggaatcatcattggcttgtttccagtggtaggttaacaagctgatacgcaatcataagcaagtgtttctcaagctatcgggggcagaaaaaaacaggtaatgtaaaccaatcagtgaaaacctgtcgtaaggtatgagtgggctagcttgtcgttttttgattattcttgggccaaaaaaagaaagaagggatcaccatcaactacctgcccaatctcttgtccattgcacggatcgcgttagctggtcttctattgatcaatcagcagcctttgttttcagtctgctacctcatttgcggattgacggatgttttagacggatttattgcacgaaactatcgattgcaaacgaccttgggctcaaaactagatagtttaggtgattttgttttttggtccattgtcctatttctttacattaaaactaagatctatccagattggatcatttatggcattgtcttagtcgctagcattcgatttcttaatttgattttgactaaagttaagtttgctcagtgggggatgctgcacacattgagcaacaagataacaggtcttgccttgtttctcctgtgtttcgtggcatttacttttggtgacgtatcaggatatatttgggtcgtgacattcctgctcgctttgttttcatctatagaggaaacactgattgtctggcgcagcacttattacgaaccgaatccaaaaggctttttcactgtttctcatcaatccagctaaattttagcaacaagagtatcaaaaaaacgtccagctgtaataagagctggacgttttttgcgtactatctattatgaatagtaatgtttatttattttttagcgtattctgaagcttggacccctgcttgacgaccaaagaccatgatatcagcaactgcatttccgccgatacggttttgtccgtgaataccaccagttacttctccagcagcgtataaaccatcaataacagaaccgtcttttttcaagacttgtgtattggtattgatttttacaccacccattgtgtggtggattcctggtgcgattttgattgcatagtaaggaccagttgttaagtcataatccattgctgtttctcgaccaaatgcttcgtcttttttatctttaacagattgattccatgtatctagtgtttttgccaatgtatcagcgtccatgtcgattttcttcgctaaggcttcgatcgtatctgcttcaacgactacaccttgttctttgtagaaatcaacttgttttgctcgacctgctaatgcatcgtcaaagatcaagtaagcatagctttctggaagagcggtaatcgccgcagaaacattgtcgcgggtttctaattcgttgtagaaacgttcaccttgttggttgactaaaatcgcaccttctccacggactgtttcactgactaacatccctgtatcttgaacaactgttgggtgaacttgaatttgatccatatcgactgttgcaccgccaagagattcaatcatcttgataccgtcacctgtactgccttcagatgttgtgctgacatagccttttaaatccggacgatatttttcaatcatttctttgtttgagccaaagccaccagtggtaacgacaactgcattcccattgatcgttttttcttcatcaccgatttttacagaaacgccagtgacttttccgtctttttcgttgattttcttcacatcagcattcacaaacaaaggaatttccttttcatggatatttctcaatagtccatctaccaagtaggttccgacagcagagccgtcatgtggacggtggatacgtttgacacttgcaccaccactgtagctgatgttgtctaatgtgattcccatgccgtctaaccagtcaatggctgaagctgagttatcgactaagtagtgtaaaagttcttggtcattcgtacctttaccaccttttagtgtgtcatcaaagaactgttggttgctgtcttcgattccttgttctttttggaattttgtttcagaagcattcatcccaccagaagatttcaatgtgtttccgcctgcgatcggcattttttccaagatgactggattcatcccagcttctttggcagataaagcagctgccattccggcaccaccagcaccaacaatgacaatgtcatattgatcttttagttcagaaggatcggtatattcttgttcagatgcacctgaagccacttctgtttcgcttgatgatgctgaactttttgctgtttcactatcttttgtcgccccgttactaccacaagcactgagcaataataaacttgcagcgccaatgaccaatttctttaatccacttgttttcacttttttcccccaactttctttcttttgtttgattgttctttgattcttccactgaaaaagcagcgctctagcactattgattgttactttattaacaaacaagaataaaaaaatattttgactattaacaatttcaattgctttaaaatcagcgttatcatctaaaaaacaaacccaacatatttatataaacataataaaaatagaaaataataaaatcacgcttatattttgtgtaatttttcattagttgttctaatcgaaatttcatttactgtgtatatgtccccattgatcagcggtgcatacatagaaatatatacacaccgcaggcaaaaccttaggaatttttctttgattgcttctggtcaaaatttatttgattgcttctattctttacttgccaactgctagttgcttttttggaacgataattttctacatctttattacacagaaatatccttagcgctttcatgattttcgaaaacggcactgactacttgttgcgaaaaaacaatcacattctcctgcaagatgtgttctcctctgatggattcgattttctttgtcagacgttcaatctctaaactgtcgatcgctccactcatgtagattgccgaacgattctggtaggtgtttgagataatgatgtctggctcttcaactagtgattccgcagcaataaaatcaatattataaagagcggagaagatctttttcagctgcataatgaagaactgttcaaatgagaaaggaaaatctgtttctacagaaacaatgatctttttctcaaataaagtaggtgtgatcagagccgtgtaggcaagaacatatcgtaagagcagaaactcctgtttttctgtaagttgccctgttgtgctgccaaaacaaatggtacgtattttattcacaagcactgggtagtagtgtctgtaatagcggatgatatctgaatcggaacctacttccaggaatccttcaaaagcgtcataaaaagaatgcaccgccaataaaatgccgaagacatttttctcatttccgccatttaacggcaatgtcaatttttctgagagactgactgcttctaaatacacctctgctttttctctttcccaaaaatcgatgatttgcttataggtcgcctttttagcgtaaaactgcgtggaagtttgcatcatcaaaaatagaaaataaatgctttcatctctaaaaaagctatactgaaagaaagaatctttgatattttgaaactctttttcaaatagatcttgagtcatattgatcgaccattgaggcatttcctccattttcaagcggttgccttttttatctctgaggatgttgatcgcaatcaagtagcaccatttatccacgatcgattgcttcagttgaaaatcaaaattaggtaagattcgctgaacgaataattctctgatatgagcataattcaattcggggtagggccactgaccgcctttacaaatcgtccaaaaaaaggaatgaccaaagtaacgaatttggctttcggacccttcaatcacgattcgtctatttttggtgcctatctttaattcaaagcgttgcagactacggttgatgcaaagaaatttttttcttaggtttgaaaggcttatgtaattcaattcacaaaactcttcaatcttaattctttttgacaatagacagttctcgatcacttgatatatgactgactgattataaatttcatgttgtatatcaaaataaatgtttttattgccactaaaagagcaccctaatgcttttttgattttgattgcttgcggattgattttttgcaattcattaagaatactatccgttgtttttcgattcacattcagtctttctgataaattaacgattgttacaaaactatttgactgataaatataacgcaagcaattgaccattaattgggttcgcttttcaaaaagatcctgaataatcatgtcttcctcctgcattaaatagaagttcgttcataagttgctttctttcatactcatataaactgacaaaacgattaaatatatatattaatttttaatctaattttaaacatttgtcgaataagtcgctcattcttcatctgttctatgtagtgcgactcaacaaaggaagaacgctcaactttttactgttataaaaaaaggcatctgactgccttctctgaccttaattctgtaattgatcctccctactacttaagtgcttcctttcagccatcaatttttaatgagaatttaactccactaactaaaaattataaagttaatctgtatcttgagaaacccaattcgggaaaatgaactcacttttttttacattgtcactagaaatgttttggcaggaactcctataaatgcaggaaaattattgttaataaagacctttttatcgctgctttcggttagccatttactgacgataattatccatgtgatgcttttatactttttcaggaaaaacaaatccccctattttatcttacacaagcaaaagagaccttcgagaatagccaaaggtctcttgaaaaaattattgttgatgtttctggactcatcctatacgaacgttcttgcgagcggtatatattttaagatgatttgcttcgtgttttttttaatgctttaaataaggtgtgatattggcctttaaaggacatggcttgttcaaaaatatcttcgccgtcattcagcatcttaacagtaacccaacctaaagattcagtaatagcactggctacccccgcgttaatggacgcgccggcgatcgtaccgacccccggtacgaacttgataatattccccacagcgcttctacctaaactaacaacaactaattctttagaaatgctttttgcgattccctcgacccacgattgaccaaacaacttgtgtagtctagccatcatcgtcatttgaacaggtacaaggagtatcgcatctgaaaacggaataggtgaacaaccaatgatggccgccgtcagagaagcggcatggatgattcgatgcgctttcttcttcgtagcatcatccacacccattaaaaattcagagaagacggcatcaaattgggtacggctttttgcttggatcttttctgccgtatgttttgacttctcaaaagatcgacgaatgatccctgccgttttgtttggtagtttggttaaaacttctgcaaagaatgactgaaactcttcttgttctgccgattctttcactggttcatccacttgttgcagcaaaatttttttttgagattttttacttttgggagtgtttctctttaatttcataaaaaccacctttaatgattagttgtcatagatttagttgctttctcaacctcttattttcatcatacactaacaaacaaaaatcacctaaagccgcgcttcaggtgttataattcttaacggaagcacaagaaatcaacttctttctaacaaaaaagctcacatgaccgatccaacgataccccctttaaacgagagtctctcccgtggtataatgactacttgtttcttgggtattatgaaagtgtcataacctctattcagagaagcatgtctaatcgagcgtgttttattcatataggcagcagctgctgccaatccccacaacaaatcatcaattgataaggagaaaacaaatcaatgacctatgcacttgaaataaaagatctaaaaaaagtctatgcgaccggcgtcgaagcattacgcggtatcaacttgacagttgaagaaggtgacttctatgcgcttttagggccgaacggtgctggcaaatcaacaaccatcgggatcattacttcactagtaaacaaatcttctggcagtgtcaaagttttcggttatgatttggacaaagaattggttcaagtcaagcaacaaatcggcttagttccacaagaattcaatttcaatcctttcgaaacagtacagcaaatcgtcgtcaatcaagcgggctactacggcgttcctcgcaaagaagcgatcgctcgtagcgaaaaatacctaaagcaatccaatttatgggagaaacgcgatgttcgggccagaatgctttcgggaggaatgaagcgccgtttgatgattgcacgggctctgatgcacgagccgcgactcttaatcctcgatgaaccaacagctggcgtagatatcgaactgcgccgagaaatgtgggccttcttgcaaaaattaaataaaaatggtacgacgattattctaaccactcactatttagaggaagcagaaatgctctgccgcaacatcggaatcattcaatccggtgaattgatcgaagataccagcatgaagacccttttgtccaaattacagtttgagacattcctctttgacttagatacctatgtgaaaccacctgtgatctccggctataaaagtgcttttgaagatgatcaaacgttagcagtcgagattgagcgcaatcaaggcgttaatgatttgtttgagcaatttactaagcaaggaatcaaagttctttccatgcgcaacaaatcgaatcgtttagaggaactttttttgaaattaaccgaagaaaagcatgaagcgggggaaaaaaatgtttagtctttattttacagcattaaaaagtctagcggtcaaagaaaccaaccgctatttacggatttgggtccaaacactcgtaccaccagtgataacgacttcgttgtactttattatttttgggaaaatgattggcggccgtattggcgaaatgggcggcttctcctacatggaatttatcgttcccgggctgatcatgatgtcaacgatcaccagttcttacgcgaacgtttcgtcttctttcttttctcagaagtttcaaaagaatattgaggaacttttagttgcacccgtacctactcatgtgattatttggggatttgttttcggtggtttgggcagaagtatttttgttggtatgctggtcacagtgatttctctcttttttgttcctttgcatgttttttcttgggtaatggttattctgacattagtgatgaccgcaattcttttctcactagctggtttgctaaatggtatctttgcccaatcatttgacgatgtatcgatcgtgccaacgtttgtcctacagccactgacttatttaggaggcgtcttctattccatttcgatgctgccaccaatttggcaagctatttctaaagtgaatccaatcgtctatatgatctctggattccgttatggctttttgggcacaactgatgtgccgattttagtctctgttctgattctagttttattcataattgttttgtacggtatctgttggaaattaattgaaaaaggccgcggtctacgcagctaagaaactgacggctatctttcaataaaaacaggaaggctgtgccaagaactctcttagttcttggcacagcctttttctaattctttttgccttgtctttcgggactgacccaaacaccgctgccgtgtcccaaaattgttttgaccgctggtatgaaggtcgtaacgatcgttaaagcattgaccatccaataaatcagcatataaaatggtgcaaaaatgaaatacttgatttttctgccagcatcgtccaccaataaactagtcaacaactgcatgatcccagcaaccatttcaaaacaaacgaataggaaggccattgtcaccatatgatacattcgttcaatgtttccttcgaatgcaaaacgaagaaaagaaaagatgaacagtactgaagagatccaaaagaagatcgaccaaataatactcaatgtttgatccacaaacatgacggaccgaccaatattttgaaatggatgagtgaatacttttttgaaatttgtcagccagacttctgtaccgcctttttccaacgtttccgttggcgataaagcatcttcatggtctcaggaacttccatgaaaaacatgatccgcggagcaaacaaggacaaccagccttggaattggtgatcccaggcaatactgatatcctcggtggcacgattttggcggaagagtcccacatcgatcaaagcattttttcgatacatcgtgttggcaccgctgtatgcatagataacacctagcacgccttgttgcgtccgcttgataatacctacgatacttgaaaattcaacagtttgtgacttactgacaatcgtcgttcgattctgaacgtccatgtttgcagtgatcgctgaaatatttaccgcatcttggcgaataaagtaattgacatatttccagagtgcatcgggttccggtacagtatctgcatcgttactcaaaatcagttctccattagcaaaaccgatcccgatattaaaggcatgggcttttccttggtttttttggatgcataccactcgtagattagggtaggtttgctgcaaacgcttaaggatttctggtgtttgatccgttgagccatcatctgtgactaacacttcgtaacgggtataattcagtttattcattaagtaatgaatggtatctttaatgaccacttcttcattatgggcagggaccatagtcgtgatcattggctctacttcttcgggaatggggatccattcaatctgttgatgcttaaacaaatacgtatgacaaaggacgccaatgaaccaagcaaagccgcctaagattggataagtaaataaaatggccactaatagaaaaaggaagaaatccactatcgggtatcccgtatcgatttgttcaatcatagagagacccccttatctttatacaactttactatttctgtttccgttagattttgttccggtttcacttcataataacaaacagaatgccgcatctcttcaggaccaaaacggtcatcaaaaaattcttccaacacttctttgcgctgttcaagttttctttcatcatgcaagacttctttccgcaatgtatggcgaaaacgccgattgttcctcacggtcaacagaacaaaaagaataactaaaagaacgaaggaaattcctaaaaacaatgctaacaatctaaaaatagtggcttcctccacataggtcctaaatcgtatttgagcggctgtttgcggaaagaaaaccgggaaagcgacccaaacgaatggtacgatcacagcaatccacgcaagcagtgtcaaaaatgattgccacaacgttaactttaaatgtcctttttcaaaaaacaaatctgaaaccagctgttgactgacttcttctctggtgattctttttttcatcccacatcctccttttggctgtaactctcttctccatctatacatcgcttattactaaaaagaagcatcaaccctggtagcggtcacaaaaacacttaatcaataaaagctatatttgacctcttgtaggactaggtctaagcgagtatacctacattttagttgaatcgattcgaaagaaaaagaaactagcttgcgccagtttccttgtgatcctattcttttaattcgacttcctaaaaagaaaaccgctaacaacaatttcaaaagttatcaggcaagtccatttttttgaacacccacgaatcttgctttttagtaccctttcatccagacagattctaattgatttccgtccggatcaagcacttcaaaaccaagcatttcttcctctggaatccccatctctacttgaaacgactgtcccccattggcttcagccgctttagcaaagtctcgagctccttcaggtgtatcaaagctaaatgcgatcaaggcagcattcgtcttttgcgtatccgcaatctttctaccatttaaaaactgttcataaaacgcatattctgacagcatcacccaaatcgtctcattccacatcattccacttgatgtttcattcgaaaattcttcattcttgctaaagcccaacgcttcataaaaactagtagctcgcttgatatcttgaacaggcaaattgataaaaaccatctttcccatgctgtttcctcctttgacaaacccgagcgacatgtcattgctcctttattataaagggccgatccagatatacaaaacaatcaatttgaagctattttcacaaaaaatgcagcggcatttttcaggatgactccttttctccatgccagctgcattgtttcatatcgatttttccgtttgttttaaagacgatcccttctgctagcagccgctgctttcgttctacggcggtaaagcccacgatctcgccgtctgctcgtactacccgatgggctggtaatgactctgggcaatatttcatggcgcgtcctacagctcgtgcaccattcaagcgacctaaagcccaagctatttggctgtaagaagccactttgccatacggaatcttctttacgaaacgatacacctcttcataaaatggattcatacctatcaagcagctcctttcaatcgttagcgaatttgcttgttcgctcaatgtacgataacttgcatgccataaagggcatgttcataaaaccattttgcatctgcaacagtcaaacggatacacccatgagaattggctttttgtcctagttcttctgcttcttcttcaatgtaatctcccgaagcgtcaatcggcaccgaatgaaacaagtagacgccatgatctttccaagatacccaatagttcgctccctcgccagaagattcattaaaaaaagtttctcctctttcagcttgaatggaataagttcctgtaggcgttcttcggtctcctcctgatccggtagagcaaaccatcgtataaagcactcgattcttccgcatgatcttcacccgctggtttgccaatgagacatcgacccaatctccttcttgtaaaacaggataggctttcttctcagatggatgacgccaatctgcgacggctacttctgtcgaagaagaatcctctgaggatttagacgttcctgatctctcctttttagtaattgcattttttttcgtagggatcgttgcttttttaggaatggtctgtttggtctgttctgtagactggttcttctgaccagcggctacgttatgtgataggctggcactaacgatgaataacagcacagcactcacaaacataccaatggttcttttagggtatctttctttcattatttctatccttactaagccgtcgaaaaatctctcaggcacaatttccagttcattttaccaaagctgcttctaaaacgtgattttaatcagcagtgacaaaacaagttaacagcagatttcgtttcagcgtctcttaaaaaactcttgataaaatgatccattagcagtttaacgcctttgtaactaaaaagccagttaaaaatgaaagagtagaaccagcctacaacatcgtgcagcgcttcaaacggatgcggacaggcctcattcaatcgggtggtaactaaaccctcgtcctaaaacttcagctacattgctggcaattacaaatgcctgcggatcaatgctttcaatcaattgtttgatatcagcaaattcttgatcgttgacaacgatcaataaaacttgtttctcacttcttcgatgaacaccttgtgcttctaacaaggttgcccctctagaaattgccgttgcaatggccgcttgaatctcgtcaagatattcctcactcatgatcatcacagacttcttgcggtccatcccggtttcgatataattcatcacgatcgaagtaatcacaatcgaaagaatcgcaaacaaaaattcttcaaacccaaaaaccagtaaactcattgttaccacaaccgcatctgtggctaaaagcccgatggaaggattgatatggaaatatttctggaagatcagcggcggaatcgtagttccgccactagaagaattatttttatataaaatagcaaccccagcagcaaaaatcgcactcccaaaaataacagacagcagacgatcactggccaacatatattcaggcactacggcaattgctaacggaaaaactatgctgccgaacagcaccttgaagaaaggcgctttccccaaaaaaacataggccagaaccaacatcacactgttcagaaccatgatcacaagcgcacggtcccagcccaaagcagattccatcaagattccaatgccactgacccctccagctgcaatatgatgaggacctaaaaacatgttgatgctcaccgctagaatcaccagtgcagagagtattttactataagttatcaattgcttcattgtcttcctcttttctttgatcatccgaatagaagctgtcatttttccgagaacttgtgcttttactataccctcatctctgagttgagacaaaatttctgttcagaagactgaaactttttttcttataggatcaagtacaggtaagaaaaatttgctcaaaacttggttgttcaggaaccttttgacttgcgttctgacgttcattttctcacagaatcgttggaaaagagaagcatttttttcagccttctctgaaaatgatcatccagaatgctgctgcatttccatctttttgcacttgactctctttagagattcccttattatcaaggttaacgattttaaatcagaattttctgaatttttaggcgagataaacaaaatgaggaaggatgaaccatttgaagacaaacaaacaaaccacttggtctggcgaacccaacgaagcagcaatccaactgctccagcaagaaggcaaagtcatcgtttgccccactaaagtaggctatattattgccgtctctgacaagaaaggactagaacgcaagttttctgccaaaaatcgcaaacgtaataagccaggagttgtattatgcagctcattggaacaattacaagaattagcggaatggaacgatgaaattgcggcagtttaccaaaaatgttgggacaacgatgttctttttggcgcgatcttaccatggaaagagtctggaaaagcatatattcctgacggatcgcaagaattgatgatggataccagggaaacgagttgtttcgtcatcaaattcggcgttcctggagaacaaatcgctaaagctctttgggaggaaaagcaacagctattgtttgccagctcagcaaatccttctggtaaaggcaatcgtggtctggtggaaggaattggtgaacaaatcgctaacgaagcagacctcatcattgaaagcaatgactatgtcgcttcgatccaaccagataaaacgatagagacccgctacgaacaaggagtcatggtttctttcgtagattctgctggcaaattgattcctcatcaaggctctcagcgatcgatcaccccggcgcctgtattgattcggaagggtttagctgtagataaaatccaactgtttttgtccgatcacttcaattcctgggactatcgccacggcgaatactactaagcaattcatagattaggacatcagtccaagcattcaactaaccttagctacgactcttcgaccgtagctgagactttagatcgaactgcttacagctgatgtcctaattttttgagggtaattcttgcatacaacagcattttcctttcaatacaactcttcacagatcaaatcatttctttgatcgtcatgatagcgttccagatttaatgattcagcttactggttacatcagtcagtcccctgaaaacagcctcttcctaaagaatagagctactatttcttgatgatcatctgaatcgcttgttccagcttctgtgcttgttcttgaggatctttttctggattctcgaaacaatctttcaagttctctgcaacaatcatgcccatcacacgatcgatacttgaacgtaccgcacttaactgagtgatgatatcgatacattccttctcttcttcgatcattttttgaaccccacgaatctgcccttcggcacgttttaaacgattcagcacatttttttgatcacttcttgtcttatccatcgtctcactcctttcccattagaatataccctacaatggtataacggtcaaacattctattcgtatccgcaatgttaatcaaatcaaatcattgacaaatatagaaaaacggggtttaatataccccataccgtatataaaggagaatgtctatgttttcattgtttcgttctgtcccttccatctctattcgtgatttttccgcagcactaactgcaaaaacgaaagttattgatgtccggacgccctctgaataccggggtgggcatattcgaaatgccgccaatgtcccattaaataaaatcgcccactattcaggaaaaaaagaaccgttatatgtgatctgtcaatcaggcgtccgcagcaaacaagctgccaaattattgattaaaatgggctatgatgccacaacgattcgcggtggcatgaatcaatggcaaggaccaattcaaggaggaaaataaaatgaaagtactgattgtcggtggggtcgccggaggcatgtctgctgcaactcgattacgccgcttaatggaagatgctgaaatcattgttctagagaaaggtccttatgtgtcctttgcgaactgcggccttccttactttatcgcaggtgaaattactactcgcgatcaattactactgcaaacaccagagtccttaaaggcacgttttggtttggatgttcgtccaaatcaagaagtactggctattcacccagaacaaaagactgtgactatccatcgagattctgagacttatgaagaatcatatgacaagttgattcttgctccgggagcaaaagcaatcataccaaaaatcccaggattagaccgtgccacaaactgccgtcagttacgaaacgtgccggatatggatgctattttgcagaaaatcgatcaacatacccgccaagccgtcgtagtcggtgccggctttattggattggaaatggcagaaagtctgaaaaaccgtggcttagaggtaaccgtcgttgagaaagcatcgcaggttttaccttcgatggatgaagaaatggctgcctatgtcaaaaatgaattgatagcgaagggaatcaaggtcattacgggccaatccgcagtttcttttgaagaagaagggaaaaaaattcggttagaagatgacactgtactggactcagacctgacattattgtctatcggggtccaaccagaatcaagattagcagcggaagctgggatcactactggtattcgaggaggaatccttgtagacgaaaactaccaaacgtcgcaaaaagacatttacgctgtcggagatgctatcgtcacgaaacaacaactaactggagaagatgcgttgatttctttagcctcaccagctaaccgtcaaggccggcaagtcgcagacgtgatcgctggtctgccgaggaaaaaccgtggcaatattggaactgctatcctgcgagtctttgggcttacagcagccatgaccggattaagcgagaaagcagcagtatctgcgggcttgcagccagctgtgattcatgtcagcggaaaagatcatgctggctattaccctgatgctaaagatctgctattgaaattgatttttaataaagagacaggtactctctatggtgctcaggccgttggacagagtggcgtcgataaacgaatggatgtattagccacagccatcaaaagtggattgacggtggcagatttagcagaactggaactgagttatgcaccgccttttggttccgccaaagatccagtgaacctgatcggctatgcggcattgaatctaatcgaagggatcagtgagtcaatccagtggcatgaactttctgcagaattagctgccggcaaacaattactagatgtccgcaatacagcggaaatgactggccgcttcaaaaacgccctgcatattccgctgaatgaattacgagaccgactgactgaacttgatccgactgcttcttatatcgtcagctgtcatagcggactgcgaagctatttagccgaacggattctcaaacaatctggctacgaggcaaaaaatctagacggggcttttgcgctttatcaaaccgtcagaccggaggaaatcattcatgtatcgctcgatcacaatgcctgaattttatcaagcaagcaaacaacagaagttccacctgattgatgtcagagaagtcgatgaatttatcagcggccatgtaccaaatgcgcaaaataatccgttatctcacttcactactgccaatttggagaaagaccttgactactacgtgatttgtcactcaggtgctcggtcagagcaagcctgtcactatatggaccagcaagggttcaaggcgatcaatgtattaggcggcacttctgcttggccaggtgaactcgtttaaaacacgttacaccaaataaaacccaatgaccgctactttgatccaagtagcagtcattgggttttggtttaaactcgtcagctaactattcaaaaacaaattgattgtggtaaagttcggcataaaacccgttttctgccaataattcttgatggcttccttcttcgatgacttgcccctcccgcaagacaacgattcgatcggcattcaaaatcgtctttagacgatgggcgatgacaaaactggtccgccctttgatggcttcatccattgcttgctgaatctttgcttccgtcaccgtatcaacattactggtagcttcatccaaaatcaataaagatggattggtcaaaatcgtgcgagcgatactcatcaactgcttttgcccggtactgaatagattgttttcttccgtgattggtgtatcatacccttgttctaacgtcatgataaattcatggatgttggcctgttttgctgctgcaataatcgcttcctcactggcatccggcttaccaaaagcaatattttcccgaatcgtcccagaaaacagtaccgaatcttgcaacacgatccccacatgctcccgcaatgcatctaaatctaactgtcgaatgtcctgaccatcaaatgttactgagccattcgtcacatcatagaagcgattcaaaagattcatgatggttgtctttccagaaccagttggtcctaccaatgccaccatttcaccctttttgacatggatggtgacatctttaaggattaaacgatcactatcataaccgaaatcaacatgattcaatgccacttcttgcttgataccagtgattttttcaccatttgccggtttttcttcatccggttcatcaaacatctcattcaaacgacgggcgccagtgattgccaattgaatcatgctgtaaccagaagaaatctgcatcaacggttgatagtattgttgagaatattgaacgaaagtcaccacaaggcctagagcaactgaacgttccaaatccccattcaatgctaaccaaccgccaaagaaaatcacgatcgccgtgttgaccagcgacattccttgcatcattgggaaaagcaatcctgagtatacttgtcctttgtaagtggcttcccgaacactttggttgtgctgcaaaaatccatcaatcgtttcttcttgaagaccgttggtgatgatgatccgttggccgctgattttttcatcaatgtacccgtttagttttcctacttcatcttgctgcagatcgacatatttgcgagctttttggatcacaatgactgcaatcaggatggcaattggtgtagacgcaatcgtcgcccaagctaatgtgacattttgtcggaacatcatgatcaaaatcccgatcatcaataccacattggtcaatacttgcagcaatgcttgattcaagctgttttgaatgttatccaaatcgctggtaaaacgactcaaaatttcaccatcttgatgagaatcaaaaaatttgatcgtcaatttttccaatttattgaataacccgattcgcatccgattggtggatttccccaccacttgcgtgaacaagatactataaataaagtttgctccacttgccaatacgtaaaacagcagtaacttccagatgacagatacgaattttgacttgtcatctacgccttgcatcaatccaccaacataattcgctaattcctgaaaggcttgccccacatagaccggtgcttggacttgcagataagtggctgcaatcacggtaatgaaaatgaaaaagaaagagagtttgtatcgttttaaatagtgataaaaaaacttgcttgctttgatcaaatccgtcatggttattcagctcctttctgagtctcaaaaatttcctgataaattggattgttggcagctaactcttgatgggtacctactccaaccagacgacctttatccaacaccaggatgcggtccgcattcacaacagaagcaattttctgtgcaatgatgatcgtggtggtagcttgcagttctttttcaaaggcttcacgaaccagtttttccgaacgagcatccaatgcactcgtactatcatctagaatcaagatttttggttccccgatgacacctcgtgaaatagacagccgttgcttttgaccaccagaaaaattactgcttcgttccgctacgggtgcttcaaaacggttcgtcaatttttgaatgaattcacttgcctgcgcgatttctgttgcatgggtcatttcagggacagtggcgttctttttgccgtggcgcagattttgggcaatggttccggagaaaagaatcgctttttgtagaacaaaggaaacggtttgacgtaagctttgctcatttacttctcgtaaatcgacgcctccaactcgcacggttccttctgttggatcaaacaagcgcggaatcaattgagctaatgtcgatttccctgcaccagttgccccgacaatcccaatcatttctccaggagcgattgaaaaactgatgtctgtcaaagcatttttctcatccccaggataacggaaagaaacgtgctcgaatgccacactgcctgctaattcttgctgtggaacatctttgtaggacaagtctggttcggtaaccagaatttctttcaatcgtttgagagagaccgctgcccgagaagtcatcatcatcatcataccgccgataatgatcgccatcatgatctgcatcaaataattcatgaaagaagcgattcccccgatcaatgtcggatcgtcttttgcaaggtcgctgacaaagaagatcgcgcctacgaccgctaagttggctgccagcataaaggacggaatcatcacagagaaaagcgtaccaacgatgatgttgtgttttgttagttcgtcgctgactttcgtgaaactgttcaattgatttttttcttgaacaaatgatttcaccacacgaatccctaaaagattttcttttgctgcactattgattttgtcgatcaaattttgaatgatcatgaaatgtttgcccatctgtgtaaaagaaagaccagtaatgatcactactgcaacgatcaatgcgacgattacccaccaaagttgaggcatcgtggtcatggctaagataaaggcaccaataaataagaaaggaatccgaaacaacgactgcaaggagatcatcactaaattttggatttgggtgatgtcattggtcagtcgaaccaccagatttcctgctgagaatttctcgatattaccaaacgagaaagtttggattttacgaaaggcttcttcacgaatatccgcactgactccttgcgctactttggcagagaaaatagtattgatgaccccagccaccagcccaaacacggctagaccgatcaattggaccccaatcgatttcatttcattgtcgtcttctttaatgattgcttccaatacttgttgcagcagcttcggctgccataacgtagccagtaccatgacagctacagaaaccagcgcaatgaagacagcgcctttgtatttctttacatggcgtaaaacaagatccatcttaaaacacactcctttacagtttgacaggcattatttaacactgtaaaataaagccggacaataatttaccatttttagaaaaatgttgcaagcgaacaaaggatgatttttttatggaacaaaagttatcaaaagaatcaattattcatgcggcttttgcctacctaaaggaaacatctgacctttctcagttaaccatgcgcaaattggcaaaagtactttctgttcaagcaccggcattgtattggtatttcacgaataaacaagagctgttgcaagcgatggctgaaacgatggaaaatgatctgccggatgtccctgcgggtagctggcaagaacagttgcaaacctttatggccaattactacgatctctatctccaatatccctgtggtgcagaactagagattcatacgattccttcctatcctagccgactgctgcatttagagcaaatgatcactatattgatcgaagccggcttcactcctgcccaaagccgtcaaaccgttcaggcattgcatcatctcttattgggacacttactcgatcgtcaaaaagaagaacaattacgagcaaaaattgtaactggcgatgaaaaattgcgggcacatgtctctgctatgcgcagctatgttgttgagaatcatttaaatgggatggcagaaggcatccaacaacgcaaacaaatcgacgaacgtcaagtttttctggagagtatcgcgatttatctggctggcttaaacaagcgaaatacctctctaaaataaaaaaacgccaacaaatctcactaagtttccttaaatcgctttccgatttcaaggcacgaggctcgttggtgtttttgttgcgttttttaaagcgttgttagttcttctttttgttttttcgtcaatttctgataaaccagttcataagaggtcaaaatcaactgttcaatttgttcgtctgttacctcatccgctgctagacgaatagaattccagtgggttttattggcatagtatccgggaataatcgcctcagggtattgttcacgtaattcttcattgacttccggtttatttttcaacgtaatgatcgcatcatcattcgcttcaggactcatcataccaaactgtttgccgattagaccaaaataaatcgtcccccaatcctcacgataggccacattagcacctgccaatgactgaccgtaacttttcaggcgatcgattcgttgttggatctgattattcattgccatccctccggtttgaaactgattttttctttagtgtaccatatcttagagggtttctttcataagcaaactgttgatttagataaaaaaacagacccgctaagcgagtctgtgatacgtatgaatgtttggcttgattaataccaaccgttagcttcccagaatgcttttgctgcagaccatgaaccataacgtgaagcaacataattatcggctactttttcttgattggccgctgaatagtccccattcaagtaagagttagtcaactgataacgtccatagtattggccatttgttgctgtataagaaccgccagattctttgttcgcgatccattctttagctgaagcttctgagcctgttgctgcagaactgcttgatgcagatgagcttgggtttgtttgttggctgctggcaggttgtgaagctggttcttcataagtgactgatgattctgcagctgctgaagaacgttcatttgtatagctggcatcgtctgttggtaagaccagtgtttcaccaacatagatcaagtttttgttcgtaatgccgtttgcttcaacaattttatcaacggcttctgaggtgccaaaatagttataggcaatcgtagatagtgtatccccagattgcaccgtgtattcttcatcagcaaacgcatcttgtccacctagaaacacacccagacctgcaaggacagctgtactaagcaaaacagttttcaatgacttcataaaataattctcctcatcttgtagcgtttatagtctgtcgcaggagaaatctccaacgcatagactagtctaacaccagagaatatttcataggtgaaaatctcgttacagatgattacgaatgcgtcgagttccttacgtttcgtaagcgtcgcgtaattccttttgaatcaacaacgattatcaacataaaaatataaattagttattttatttcaataaaagtgaatcccctcttttttatttgtgaattgttacaaattggatgaatttacacacagtcgtaacaaaaaaagctgcagctgaacagcgcgtttccatgaatgcttgttgcatcgattggaagcaggcgttcacttgctgcagcatctttcgctgacactttatcaaaccgtttttttcactggaatcaacttattcatcacaatagcagcaatcgcacttaacgcaatcggtgaatccaataagtattgtagaaattgcggagtttcttgtttgatctcagccggcatgaacaaaagaccgatcgctaagattagcggaacaccaataatatagagttcacgttcagaaaactcttcattcttgatcactcgaaagccgctaagcaaaatgatcacacagacaactgcgaagacaccaccgattaccgctgaaggtacggcatggatcaacgctgataacttgccgacaaatgacaagaggatgaaccagcaggaagccatcacaaagacttttttactggcaaccccagtaatggaaatgataccggcatttgttgaataccccgtcactggtgtcgttcctactaaagcagccaccaggcaaccgattccttcaccaatgacacctttattgatttgttcatctgtcacagcttcctcagtgacagagctgacggcataccaagttcctgttgtttctgctagtaataccatataaatcaccagcatcgtcaaaatagctgaaacatcaaaatgaagaccataattgacgaaaataagttttggcaaactgaaaaatgaagcatccgcaacagactggaagcctacgccgcccatgaaccaagcaatcagcgtcccgatcattaaggcaataatcaccgagctaatccggaaatatttacctaaacgagggaagtaatcacctaacatcgagaataaaatcaaaattgctgctgtcactgcagccaaaaacatgttctgattagccgataatgtctcagtagctggataaatgttgctggtaaaagctgtaggtaacaatgtcagtccaacgatcatgataatcgtgccactgacgatcgtgggaataaagttgcggacaatatacttatagatccctgtcatccctaaaagaataacagccaatgccccgacaatactagctcctaagacagtatccataccttgcgctccaaaatagataccaatgattgcgcctactggtacaaaggacggcccttgacagacgggcaatttcaagaaaaagagaacttggatcagcgaagcaatcccagcacctaaaaaggtggattggatcagcccggctgcatccgacgagctcatggcaacagcagttgcaataataaagggtgggacatacacatccattgccaacacgtgttgtaagccaagaacaatggcttgtcctaaaggtatatcttcattcattccgatcgttaaacgattacttctggtttccacagtatcaatctcctcatttttcatgtactttttttccttgcacccagacctgacgaatgttttcagccgttgctagatacaaaatcttttgtaattgttctttcggttggttcagtacaccaaaagctggcaatggattaccagaataacaagtatcgatcacttgaaggtcgcaagcgtagccttccttgataagaccaatcggtagtcgtagcgcttcgccccctccttttgtcgccaatgaaaaagcgtcgatgactgagatacgcgcattcgcaacacctcgattcgtttggggcaatgtaacatccacaccgtcttctaacatgcgggaagacataacagcttgcttgatattgtcatacaaacttggagaaaagccgccggagatatctgtgcctagtccaatcgttacgccttgttctttaagccgattgatagggatcacaccattggcaaagtacgcattggaaatcgggcagtgagcaacagcagtccctgtttccacaaagatctcaccatctttttcatcgataaaattacaatgagccatcacagctttttctcccagtaagccaaaatcccgcaagacttctgtgtcggttttaccaaatcgttccaagacgtgatcgtgttcccattggccttcactgcaatgggattgtacatggacatcgtatttttgtgcgagttgtcctaacccagccagaccttcatccgtgcagcttgggacgaatcgtggtgtcactactggatagactccttgacgtgtcgtttttgccaacttttggacttctttaatgaaggtttcggtctctgctagtgccgtagcagttgaggcatctcgataaaaatctgggttcgcgtcgggatcatccatgactactttccccactagccctcgttgacccttctcagcacaaatcttggctaattgtaaacttgcttccaaatgaacggtcgcaaaataaagaaccgtcgttgttcctcgagccagtagttgcgcaactaaatcttggtacacttctgaagcaaaacttgagtccgcgtattttgcttccaacgggaaggtacactcatctagccatacattcaacggctcatccaatgcaactcctgcttgcggccattggggtgcatgaacgtgcaagtcgacgaatcccggtaaaaaatactgtcccttctgcaattcaactagcattccttgtttggcagctgccagcatttctggatagtctgattgttctgttgtgaccacccttttgatcatcccttcagcatccacgcaaatgaggacatcctctaagtattccagcacgccatctgtgggtgtatgaaatacagaacctttaaaatattttgttattgacataagttttctcctttaacaaactgcatcagactgctgctttgacattagcagttttcattaaaataagcatcaatggttttattttacattcattcggatttttttcaataaaaaccgtacattaatcctgacaaaaagaatctaatgttcgtttttaaggcaaaaaaagacatttggtgtgttcaccaaatgtctttccttcacttaaagctgaattgtcgtaccactattgccagctaaagtttccgccgctttttccaatgaagcgatcactgcttgacgcccatccttggaagcagcaaatgcgatcgctgcttccacttttggcaacatactaccaggtgcaaattgatttcggtcaatgtacgtttgcatttcagcgacagtggctgttgtcaatcctcgttgatctggttgaccatagttgacaaagacttggtcaacagcggttaagataataaagatatccgcatcgatcagtgccgccatcttggctgcagcaaagtctttgtcaatcaccgcgtcaactcctttatagcgagtgccttcataaaccactggtatgccgcctccgccacatgcaatcaccacttgacctgcatctactaatgtttttagactgattttttcataaatgtccactggtttaggagaaggaacgacccgacgccaacctcggcctgcatcttctatataagtgtcgccgctttcagtcattaattgctgagccttagcttcactatagtagccaccgattggtttcgttggattcgtaaaagctggatcagctggatcgaccaccacttgcgtcaacatggaaacgaccggaatattttccaacccgcgagaaacaagctcttcatcaatcgcttgttgcaaatggtaaccgatgtacccttgactcatagctgtgcattcaggaaatggcatgacgtcttcttgcgttttgctggtttcctcaaatgctaagcgaattttgccaacttgaggaccattcccgtgagcaatcaccacgtgatggccgtcactgattagatcagcaatcgattttgctgccacttgggctttggtcaattgttcgtgcgcagagtcgcctaaagcatttccgcctaaagcgatgacaattttcgacatacgtctcctcctatctttgcggttgttgttgcgtgatacagtgaatattcccgccaccgtatacgatctcaactgtatttacgcccacaacttctttatctgggaaaatctctgctatttcttcaagtgcccgcgcatcattttcgtctccgtattgaggaacgatcacaccgttgtttgtaattagaaagttcatataagaagcaatacaaatgtcgccatcttctcgcggcatggttccttctacgtaatcaatcttgaaatccccattgatcgtgacattttctactgggcagcaaagcttatgaacttttaatttgcggcctttggcatcggtcatttcattcaaacgcttgtatgcagcttgagccgcttcataaaatgggctgtttttatcttcagtatagatacaagccacttctccaggacgtacaaaacatgccacgtcatccacatgtccattggtttcttccggatcgatcccgtcagctaaccaaaggaccttctcacagttcaagtagtcgcataatttttgttcgatttctgcttttgtcatatgggggttccggccattactcaacaaacacatctccgtcgttaacacagtgccttccccatcgacatggaaggatcccccttctaaaataaacccttccgtccgataagaatccacttgctcgatctcacagatcttttgagcaactaaatcatcttgatcccaaggaaaatacaagccatcgactaatccgccccaagcattaaatccccagtcattgcctcgtaattcgcctttgtcgttgatgacaaagctaggaccacagtcacgaatccatgcatcgttattggacatttcatagacagtgatgtctgcaggcaattgacgacggcagttttgatattgttgttgcgacacgaccacattcattggcgtgaatttgctgatcgcttttgcgacttcagcaaatgcttcttgagctggtttgcccccatcacgccagttatccgggcgctctggccaaatcatccatactttctcttgtggttcaaactctccgggcattctaaacccgtcttgtttcggtgtggtcttttcgattcgtttcgccatgatacagcactccttcttttttgatttttttgatccagataatggcttcaccaacgagggcaaatacaattgctccaatcgtgattggtaattgctgactcagtgattcagcgtcaaattgcaaaggaagcgctgtgaaaatcaatgagatcacgatcatgatcatcggtagtgcgactaataccttcaagaacaaatcgctgccgctcaccttgaaaggtcgaggtgtgtctggatcaattttacgtaatttataaaacgcaggaaacacagggacatacgatagtaggaacattactaggttcagtgagaaaaatgcccagaataaatcttgatttggtaaaattggggcgatgacgacgacgatagaagcaacgataccattcataattgccgcaccagtaggcatgccattttttttgctgcgtttggcaaatactttcggcatatcgccattttcggccgcatagcaagcagtattattgacccctaacgaccaagaaatcatgttgccaaacaatgtcagcaagaacaaaaaggccatcgaaataatgaaccagccgcctgttgatcctgtcaataatttaaaactatccatcaatccactgccggtactgatttgatccgtaggaatcgctacaccgatcccgaaagcagaaaaaatgtaaatggcggcaatcaccagtccaccggcaatgatcgattgaggaatttgcttcttagggttttccatgtcacttgcaaatgtacaaatcacttcgaatcctaataagttaaaaatgattaccgagataaaagacaaactattcaaattgaagcttggcaccatcgaagaaagagtgaactcattcgcaacacctttggtaagggccgtatagagacctaagccaccaatcaagattgctaacagcatcttgatcactgctgccccattcaaaatccacacactgtcactgaccggataaaaactgatccaaacgatgacccatataaaaatcagttcgatcacgatagcagccaccgtggaaaattcacgacctgtgatagtcgtcaacaagtcaggacagactacggctagagaggctaaccataatggataattgatccagtagtaccaagaaacccgagaaccccagcgatgaccgaaagcttgtgtcacccaatcataaataccgccatcaccaatatacgttgttcctaattctgatgagattaacccatagggcaaaaggaacgcaaccaatagaaagatccaccaaaaaaactgtgaatttccgattgctgctaccggtgcagccgcttctgccacaaatacaacacaaataaccgataagatagcactcatcaaactaaattttttcttttctcccattgttttcttcctttccggtacaagggaataagggttgaccaacgattgaaggattcttgcaactagcggatttctctctcgtgaatcccagttcagcacataagctgcgacattattagaacgagcttccgctcaaaagaatcgattcgcagttcgttggcccctcctcaagaaccaaaacagtcttcacgcatccccttgatacgcagactatttcctttcctcatctcttgcgtctagtttcatctaacaaaacttccaagtctttttcagccgctgcttttttggtctcgtcgattggatttttatccgcataatctcgcatcaagtacactaagagaccgcgaatcgacgttaaccggttttctgcttcatcaaaacagatcgagtttggtccatccatgacctcatccgtgacttcttctccacgagtggcaggtaagcagtgcataaatttcgcttgttcaccagcgcgtttcatcaagtcagcgttcacttggtatttagggtaaaaaatacgcatgcgttcctcttctgataattctgcttcatacagtccataccaaacatctgtataaacaaaatccgaaccttcgatcacatcgatttgatctgatatcgtataggaaccgccagaatctttacaaatcgcgtctaatcgtgcgcgatggtcttcgtttaactggaacccttctggaccaaattgaacgaattccatccccatttttgttgcaatcaatcctaaagagaaacagacttgtgtggcatcaccaataaaggaaatcttgcagtcttcgatttttttgcctgctggaagatgttcgatcatggtgcaaagatcgccaagttcctgcgttggatggttgaagtcagacataccattaataactgggatcgtcgcattcgttgctaagtcatacacactatgatgccgttccacgcgagccatcaaaatgtcaactaaacgagaaagaacacggcttgtgtcttctattgtttcatgaccacccaattgaatttgtcctggtgcgagatattctgcatgtcctcctaattgtgtcattgctgtttcaaaagaaacccgagttctggtagatgattgttggaaaatcatccctaatactttgttctttagtaaaggggggtaataaccatttttgatggccgctttgattttcaatgacaggtcaacgatttgttggatctcctccttcgtgtaattttccgttgtaataaaatctcttttttccataatgaaacctcctaagtgatttgtttgcttttgcatcttcactttaggtaaaaaaggcggagtttacgataagctattagttgtaaacgttatcacacttattctatacttgctgaggacaagtttatttttggatataaaccagttattttccaagggtttacaaaagtttagaggaaagtttagcggaattaaaagtaaagaaaaaacaaatggtgttataattaggataagaaaattggtgtaagaaaaattgaaaggggattcaatatgatagctatttttatatacaatattttattgatcattctatattcaatcacgatgacttttgctatttattcttacttaaaagaaaaaaacaaattatttctttggattagtttgtatctggcattctttatttttgacaatacaattatttatatgacggaatttctcaattcctttgcccaaagttatgatcaagcatttatgagtgcaccagcagttaaaactattatatttatgggaaatgcctttttctccatttctattcttgccgaactacacaaagaaaaaacctctcccctccattatacgctattgatcgttttggccatttggatgattacgaccccactgatggaaaactcagcatttaaagtttggctctattatctgggtaatcaactcttccttttttatctaggaatttattgttggcaagggaccaaaaagaagctccctctactgaacaaacgctatttaaaacagttgatgatcatcaatctcttctttagtattttgatcataattgaagatagcttcgtgattttcaatgtcgaccagtacagctcgttagcgacaaagatttataatcgcagtatttcagaggatatcttttcgattgttgtttgtatattattactgcacttctttatcaaagaacgccaaccacaggaagaaaaaccgcaagagcaagacgcctctctcttgattcaaaacttttgccgtattcatcagtttacccaacgagaaacggaaatctttgcgttgctgttgtcccatcaaaccaatcaggaaatcgccgatcagctctttctttcattgggaacggtcaaaacccatgttcataacatttttatcaaacttgagataaaaaaacgcacgcaaattatgattctttttgaaaagtacaaagagacccatgaggcagctgcctaaaaaagacctggaaggatcgcttccaggccttttaaagtttaaaaaccagtcattcattgctctgaacggcttattcttccatatatgcatacttgatgatcgttgacggtccgaaagttggatagtacacacctttcagggaaggattgaccataatactacgagctctttggtagattgggacaatcccggcggtttcttctactaatagtttttctgctttgatcatcgtatcccaacgtgtcgctaaatcattggcataggtcgtattgctatcagcaatcaactggtcatagtctttattttcataattcgtgttattcggtgaaacgagattgtaaaggtacgtcatcgggtcttgataatctggtccccatgttccgatagctaactcgtaatcgctttttcgtgtcaattcaatcgaattattcaatgggacagacttgatttcaacggtcaagcccggtaagactgtctgtaactgatcctggatgaattcagccacttttttatctgcatcagtgtctttggttaacatctcgatggagatcttatccccaatatcagcagtggctttttgccagtaagcgagtgcagtggctttatccggtccttcgagaggcgcatcttctcgaaaatctttgccagtttccggattgaagacaaagttattcggaataaacccattgattgcttctgatccatctgataagacatctttgactaaagcttctttatcaatcgcataataaacggcttttcgtacattttcattggcaaagatcgtatctttaccatctcttttctgattcatcttgaaatagtggatataagaggtcagcaccgtctgtagttcttcgttagcggcattttgcttcacgtattccccataaatatccgccatatccaactgtccttcgttgaaaagattatatcctgtaacagcttctttgatcacttcataatggatattctccagtttgatggcatcacgattgtagtagtcttcatttttttccaaatcccatgtagaggaagcttgatcccaatttttcatcaaaaaggggccattagttaaaatattttcacttgatgtgccataagcatcccctttttcggtgacaaaagcttcattttgtggaaaaaatggagtaaaggccaatatcgaagtcaaataaggaactggctgttccaattggatctcgatcgtgtactcgtccgtagctttcgcacctagttcagaagggtctttttccccattgatgatttcggtgccatttttaaatgtaccgtccaataaaaacatgtagtttgcttgattggctggcgtggctagccgttgccaagcataaataaaatctttagccgtcactggctccccattactccaagtagcatcttctctcaacgtgatcgtgtaagtcagaccatcgtcggatatgttggggaaatctttggcgatagccggtgcgaccttattggtgtcatcgatttgatacaatccatcaaagacattgacttgggcattgatacttgccgtatcttgtgtagagagtgtatccattgatccgatttcgctttgttccatcaaattgaccacactgctcgcttgggcagtcgctttggattctttctgataactacaacctgaaaaaccgatgacgctagcaacaaccaacaaaaacatcattcttttttttcctttattcctcatttacgtcctccttttttacatgcgtcccaaccgcttatcgaagcgctttttctaaaatcgtcatctcaatcaattcagcttgccaatccagctcatcatatcggtagcctttcttggcagactcaaattctccccgctgattgtcgatggggtctgctcgtaagaattgcttcgctacggtaaatcccccttgaatacagttattagcaggtaagcgaaaaatatctaggtttccaaaataataaagccagcgctcttcatttccgcctcgaaatgcgctgcccccaaacgaaacatctacataaagccaaccgtactctggtagatagaagcgcgcccagtcatgagggcccacaaaaaattctgaaacatataaacccgactcccattcagctgggatattcgccatacgacacaaagtgataaataaaagtgcttgaaccccgcagtctcctttctgattgactgcgcagtactcactgatattcggaatcgcataatattctcgcataaatgaataggtcactttggtggtcacaaaatgataaatcgcatacgcacgttccaagggattttttgcttccggcaaaatttcctgcaataattgctgtagaaaaggcgtaaattgaatatggggagcgaattcattgagcgctgatgcaaatgcgtttttttccgactcagtcaactcacgaatcatggtttgctcatccaacaactggaataaatccgtataaacagccgtcaattcatagctgtgttccacagtcgcttcaattgaggaagggtcgttggtttcaaatgcgatcgttcgctgtggtgcagcgaagggatcaatctgcttgaccgctccttttgtctgaagaatcttggcatttgctacctttccagtgtctcgaggcaaaggaatgtgcgtcaagaaaggaccgtcttctttattaagcgttgttagtggtctaagtgattgtttcaaaacgattcgagcagtcctttgtccgagttgtttcattttttctacattctcatccagttctacttgtctggcactgtcaattccgttttcttcctcaaataaatagcgcgtataatagtctgagcgcgtcttaacgagattagcaataaagcgttcatggaaaacttttttgccgttcaagtagatccattcaacctctcctgcttccactaagcgatccagttcttctcgctgaaaatcgacaaaggactgttgcatcatctccagagctttcgtttcttcatagggatattgctttgcttcaaaaacagtcaaaacctttaattccgtttgcaaacgatcttttaagacttcactgatacgggcattgttcagcttctgatgaatgagtctacgtgttaaagaaaaatcaccaaaatctttggctcgttgaatgtcttctggcaaaggaaccactagattggatagatcattaggatccatactcactgcgccacctcctctttttgtttaacgcctaatccagccgcttcattaagttgaatcaccggtgttttttctgtaccaacaaccccttcatacgcaagaactgctaaatcaaacgtcgcgtcaaggtcagcgaaacgaacatttttttgtgcagcaacaaagtgagctgccgctgcgatactaatattggtctcccctgccatacaacctaccatacaagggatattcgcagcttcgcaaatactattgatctgtaacgctggatagatgccgccacatttcatcaatttgatattgacagcatctactgcatcttttttgatcaatgataacgcatcttggggtacaaatgccgcttcatctgccatgatctgttggttgacttgagttctgataaaggctaatccatcaatgtcactagcaggtgttggttgctcaaaaaaagcgatgtcatatttctgcaactgttcaatcatttttattgcctgctttgctcgccaaccttggttggcatcaattctcaattcgatggctggaccgacagctgcccgaatttgttttactcgttcaatatcgtctttctcatccaatccgactttgatcttcagtgcagtaaatccttgttccacaaacaattgagcattctctgccatcacttctggagtatcgatggaaatcgtcatatctgtctctacttggttatcctgaccgcctaacaactggtacaaaggcagtcctgtactttttcccaatagatcatagcaagccatatcgagagctgctttggcagacccattgcctttcaggcactggttcatgatgctatggatccggcttaattgccgtggatcttctccagttaatgcatcagccaataactttagagcagcttcacagccttcaagtgtctcccctgtcactaagggttcaggtgttgcctcaccgatcccaaagtcccctgtgtcagtgatcactttaatggtcaaattgctgacctcagtaataacgcctaatgcaattttaaatggcttgcgcagcatcattttatttgcagcaatttccacacgttcaattttcatcttcattcccccctctaacttaaaactgactatatcattccgtttttttcttttcaacactttttctgaattttctgaattttatttttatacagattatgcataactctaccaacttatctcctttgagcagtaaatttaataacaaaaaaagagcaaaaatttgctcttttaatcagataattgtattttattaataatcgtcggatgccaacgaacattgatttgtttgattgtatcaagcggacactttggttgtcgatcagctgttaacaaaccgtttttttcctgttccacatccgtcaactgcgtataacaaaagccgtgaagaatttctgactgatagacagcatcaatcacccgctgatagtcctgaataaactctgcttcattagctgcattggtatatccccagccttgagcccctgtatcatagccgatcccgccaaattctgttaacaagataggaacatcttgatgttgaaatcctggacaataaatttttctgcgattgggttcagaagttaaaatcgtatcttttgttcgcaaactcgccgcaaaatggtcgtatttctccagttcttctttcgttccatgaacatagctgtgaatcccacaaatatcactttctgtcatctcccagccatcatttgagataaccaatcgagtaggatctaaagaatggatcaagtgataaatcgcctgcgaaaaatgctgttgctgacgatcgacactaatgttcggtaccccccagctttcattgatcggtacccaagttgtgatacaaggatgattgtagtcacggtcgatgatctcttgccattcagccatcactttccccccgctagttcgtgtataaacactcggtgaggcacattctccccaaacaatgaatcctaactgatctgcccaaaacaaaaaacgggggtcctctactttttgatgtttgcgacagccgttgaagcccattgctttggctaattcgatatctttcttgtaatcttcatctgtaggagctgtcatgagacttgtgggccagtagccctgatccaacactagtttctgataatacgggcggttatttaagtggaccatgccatcttgaatatgaatttttcgcatgccaaaatagcttttaacggtatcgatacactttccttgtgaccaaacatcaaagacgacatcaaagagattcggggtctctggagtccaagtccatccgcgaccgtgaaagtcactgcggtcgatcttttgattgaatagactgtaagagcgtgtgaactggtgctcggtcaactgctggcgatcagaaacgatcagctcttcgccgtaataaattctggtacacaattctttatccgtcaaatcaccagcataatgataggcgatctctacggatccccgatcaaactcactggtataaaagaccttttctaaatagccgtttttgtcaactgcctccaaccacaccgtctgccagatacccgttgttcgggtataccagatagcagcagaatgttcctgccaatattgcttgcctcttggtatttcttcatctgttgatggatcaaagacctttagtgtgagcagatctttgtcaaaggtcaaatagtgagtcacatcaaaagaaaatgaggtgtgtccgccaatgtgttcccctactaactgatggttgatgtagacccagcaatggtaatcgacagcgccgaaatgtaacaataaacgtttgtcttgccaagtatctggcaccatcagctctcgctgataccaaacaccgtcatgaaagcttttgatttcaattccactttgcttggactgaaagacataaggaacttcgatcatctgtgtcaatgcttgtggctgttgttcctctaagttgtcggtaaaatcaaattgccacttaccgtttaaattcagccatttccttcgttcaaattgtgggcgcggatattctggtctgttcatagtcgtcctttccttttcaattttttttattacgaggcaaactagcctttgcttccagaagtaagactgattccttgaatgaaatacttttgaccgaagaaaaacaagactaacgcaggaatcgtcattaatgtagaagccgccatcatgatattccattgagaagaaaattgcccttttagttgcaataatccgagagctaatgtttgtttgctaggatcattcaagtaaatcaaggggccaaaaaaatcattccaagtattcataaacgtaaaaaatcctacaaccatcatggcaggtttaactaacggaagcatgatcttataaaaaatctgccagtgggttgcaccatccaggatcgccgcttcatctaattcttttgggataccagcaaaaaattgtcgcatcaaaaagacattgaacccaccaccgccaaaaaaggctggggcgatcaaaggtacaaaggaatttacaaatcctaatttattccacatcataaatgtcggaatcaacgtcactgcacctggaagcatcattgtcgcaatgaccatcgcaaaccacatattcttgtatttaaagttcaagcggccaaatgcgtaaccgcataagcaagaagtaaagacattcccgataatgcagggaataataatcaaaaacgtgttaacgagataggtctttagatccaaaacttgaaagacatctgcgtagttagaaaataataattgatcaggcagccacttaggggggaactcaaaaatttcataggaatccataaacgagctgcgtactagccataaaaatggaaccaatgagatcagtccaatcaccactaatggaacatacatcatgtattttgcttttctcatggtcatttttcttgccctccataatacacccaattttttgccgtaccaaaaaccagcatcgtaaacaaaccaataatcacaaataggatccatgctaatgcggatgcataaccaaactgattttcttggaatgctttccggtagatcaacaatgcgtaaaacaaggtcgcattattggggccgcctccagtcataatgtatgcttgcgagaatgtctggaaagacccaatcaaccccatcaccaagttaaagaaaatgatgggagagatggctggcaatgtcacatacaaaaatttatggcgccaattgccgccatctacttccacagcctccattaggtcttggggaacatcctgcagcccagctaagaaaaccagagcggtaccgccacatccccatacggccattaaaatcaaagatgggatcgctgtttgttcatcaaaaatccagttagacggcggcaaatggaaaaattgcaaaacagaattcagcaagccaaaatccgggttgaataaccacatccataaaatgtttgaagccaccgctggaactaccaccggcaagtagaacaatgttcgaaaaaatgcctgtcctcgaactttgacattcatcaacaatgcgatcactagtgcagcgatcaaactacttagcgtactgccaaaagcaaaggtgaatgtcacaaccaccgattttttgaaaaaaagatcatccataaaaatcgtacggtagttatcgatgccggtaaatttgaaatcaccgatgacattataatctgtaaaactaagaatcagactaacgatcattgggatgatggtaaaaatcaataatccgagaattgcaggggctgcaaaagcataccctgcacgattctcttctttgtgtaaatcatattgtttctttttagattgttcatctgttttaagtgtgatcattccttcgtccacctacttcacatactcgtatttgtccccgaactgtttctctagttttggcaaaatgtcttcctcaactacttctcttggagctttcttgccagtccagacctgttctaacgcggggttcacgatttgctcgatcgaagcagcatcttcactgtagaaggccttgttttttgtcaacgcttgctctttcgcttcaaccagtgcttcttttttatattctggtgaacgatcgcttacggcccatttttgaaggtacgtttcatctgagaaccaattgtcttggttaggtaaccataatcctgaatcgatgacatctaaactattctcagggtctaaaagatactctaaaaatgttttggtttcttcccaatgttcttgtgtgttttcattatcaaaaaccacgattggcggaccaaaattcatttgaacgacttttcccatttttggtaaaacacccatacctaacgctaaccctttttgttcgatagcgtcccccagggaacgtaagtcccaagatcctgtgatcgtcatcgctactctatctgtcagcattgcggtatcagttgaaggaatcgtacttgcctgtgagggtttcggcatcacataatctttgtacatcaaatcctgaattttctctaacgcttcaatcgaagcatctgttccaatcaggatttttttgccgtcctgactaagcaccccaccgccattgctgattaagaaagattcatagcctagaccagtaaaattggagatcccataggttttgatatttttttcgtcaaaaccagcatcgcctggatgattgccatttcggtcgactgtcagttctttcagaatggatacaaatttatcccaatcccacgcttgattgacgtcatgaggtggaacttcaacccccttttcttcaaaatatttcgtactgtagaacagtgtaagcattcctggccctgcaggcgatccaaagactttcccgttgtactccgagcgtgtctctgcgattttgttctcaaatggtcctcctgattcatacagctctgtcagatcccttaagttgccgctcttcccccactctgccgtgcttgtttcaaccatatagccgacatctggaagtgttttggtactagcttgtgtgtttagcttctccatataattgtcataagggatctgctgcgcttttacttggatctcgtcttgtgattcattaaagtttttgattaatttatcgatcgaagctttctccaatgtatcgccccaaaaagaaaaattgagggtaactttactcgcttgatcaccagcatcattattgctcccacatcccgataataaaaaacttccgcctataaccaatgaggaaatgagtagaccaatttttttcatcttctttgctcctgcctttttatattccatttgtatgcgcatacaatagttcaaaaagaaaatcagacggattattttttacaaaatgattgcttcatgttgccaaaataatgctgtctgtttttctttacaatttatactatacaaaacgaaaatacatatttcttcccgagttatgtgttccttattcccgatttttgtttggctctattttctaaattagaaatcgattacatttattctatcaggcacatcacacagtaaaataaagagagcaacaccgcatcactatctatagaacaaaggagtagaatacatgagcttatacttggaaattcctgaaatcaatccgctgttccctttcaaaacctttacaaatgaagggtggtcgatcacttatcctcactggcacaaagaaattgaatttatttattgtttggaaggaactgtcagattaggggtggatgacgagatcattcaaatgcatgtagacgagatctattttttttctagtggtgaaccgcacttcttcttgtcttcgccaaatagtgaacgaatcgtttatcaatttgatatcaaactctttcaagggcatgacaatatctcgccaaatgatcgtccattggccaaagtatttgagaccgtcgtcaattacagtaaagattggcctaccccgatccaaaaagagatccagactatcttgctttctatttatcatgaaaaccagaaacagcgtgaagggtatcaatacagtattttgagcagtttgtataaattagcgaatctcttgtaccaactgccattgaagaacaaaaaaacagaaaaagccgctttagatagtacattaaaaaatcgcgagacattgttccagatcgacaccatcctcgactatattgagtccaattatttacatgcgatcacgattcaggatgttgctgatcatgtggggtttagtcctagttatttctcacgcttcttcaaaaaaaatatcgggatgtcttttaccagttatctggcagaataccgcatccatcgggcaaagtatattttaggaacagagctggttcccatggcagaagtagctgcccgctcaggtttttctagcgtcaaaacctttcatcacgtctttaaatcaatggttggcacttctcctatgaaatttcaaaaaaatattttcggctttcactaaataactacgcaagaaacctatatagtcaccaaatcggcgaattctgcatttataacattttgtccaaattaggcaacgcccaaccataaaaaagagatctggaagcatcagatctcttttttattcactctaaattgaagtcctcaaaaaaagaatcaattggtttttttaccaattgattcttgcgaatgatccagcaaacagttgctcacggcttacaacctcagagcggttgctgacatctgctcattatagaatgttgtcatgctctatttacagaccttctttcagatgttctttgctagtttttctcacccagatgtctttaccagtttgttcaataaataattcagtttcaggagctagctgacactcaactttaccttcctttaaagtaattcgcaattcttccccttgataaaaaagcttaaaggcaagttctgttatttcttttggtaggtgattggacaagcgaatgccttcatcataataaagaccagcaaaaccataaatcaaacttagccagctgcctcccatatttgccccatggatgccatcgacgacgtttttttgcagatcagtcaaatccatcaatgccgtatccatgaaatagcgatatgcttttgctgtttctccgatacgactagccatcacactgaaaatcgaacgagacagcgaagaatcatgggtggtgactttttcataatactgataatcttgttttagttgttctagggtaaaatcacccgtaaaaagcatttgcgctaatacggtatccgcttgtttgcagacttgatgtttgtaaattatcatcggatgataatgcaacaataaaggatagttagcagctggtgtctcttcaaaaggccagacagattgttcaagaaactcatcatcttgcttggtaagtccacgagacgcatcataaccgaaatacatgaggtctgcggcttgctgccattgatcgatcagttccatatgcttttcgtatcgtttcgccagttcaatggcataatataaattgttttgagccattttgttggtataaaagttattgttgaccaatgcactgtattcatcaggtccggtgaccccattgatacaaaaagaaggtttgccgtctttttcgatgaaatcaccataactcaaccaaaattttgccgtttcgaaaacgacttcactgccgacttcttcaataaagcggacatctcctgtgacccgttcatagagttgaaaagcataaacgatatcggcattgatatgcagttgtgcggttccggcaggataataggcactcgtttcttgaccatcaatggtgcgccatgcaaacagtgcaccgtcttggctcagctcttgtgcccgtttttgcgcttgcggtaaaatagttgctcgataagtaagcaatgctttcgcagtgtctggattggtgtaagtaaaaaaaggcaacaaatacatttcagtatcccaaaaataatgaccttcatacccttcacctgtcaaccccttggcagcaaaattggttctgccatcacgtcctgccccctgattcaggtgaaacagattgaagcggatccccttttgtagttcttgatcacccgtgatttcgatatcactcgctgcccaaaactgctgatagctttccctctgttcggcaacaaatgtttcaaaatcaaccgcttcttgataaaagggtgcgccctctgcttcttgtaatcgcagttgaaaaatcgtcgtcagggattctccagattggatttgcccatcgccgcctatcacccgaatcgccagttttttttgactatgaggggctgtccaaatggcatagtcgccatgctcttctttcagaagctgatgctctttattcgcaacacgaggatcatctgtttgattgactgtgaagcgctggtccaatggatgggaaacagtgattggctctgtgaaatttgcatttttgattgtgtaacgacaaacataaaattcactgcgcgtcatggaggcaaaagattgcatctcaagatcaaagcttttgcctaatggggtttctacatggtaagactcatgaaggatgccttctgccatatctaatgtcagctggatttgttccgtctgccaaacgctgtccgacgactgctcttgtccgatgcttaaagaaagcccccgcaggttgggtaacttgcagatggtttggtgttctttagcatagccataagcccattcgccgtattggatcggttcactgtcaaaaaaaccattgacaaaagccccgggattcccaggatagttcgcattcactttaaggggatgccctgctcggacaccgatttgaccattccccacagcgaacagcgtttctaaatattccggtttctgatgagagagttcttgtgcctgcaataaaaatcgtttgtccatctctgttcgtctcctccgcttttttctttcagttctatcctacactactaaacacccattgcaaagaatccgacttcagctgggaggggcatctactttggttcttctgacagagtatggtaccatgaaacaaacttgaaagaaggcgattacttggatttatggctaacaaatattcgaatggaaacaagctacatcaaagaaaatggctggtcctctggcagccaaaccaaacgggcggcgattgggatcagtgaagaaaaaattaccgagatccttcccatggatgaatggaaagacacgccaggaataactgttatcgatggtcaaggccagttattgttacccggcttgattgaaaaacactgccatttggataaaagcaaattaggaactccatggcgtcctgtcacaccggcagccaacttagtagaacgttttgaaacagagattcctcaattggatgcattgcctctttcgattaaagaacgggcacaacaattgatcgatttggaattgcctcatggtgtcgtgtcctttcgctcccatattgatattgaaccaatgactgaactgcgctattttgatgcactaactgaattgcttgctgacaaaccatttggtacggaacttgttttgttcccgcaacacggtctgctgcgatcaaatgccgtcgcattaatcgaagaagcattagctactggtaaagctgcattcattggtggggtcgatccttatacattagatcaagattatcagcaatcattaaaaacaacctttgagctggcaaaaaaaggcaatgttggcatagacattcatctacatgaccgcaaagaagccggtcgtgcaacgatcaaagaaatcattcggctgaccaaagaatatgctatggcaggcaatgtcttcatcagccatgcctttggcttaaatgattttgaaggagctgaacgcacagaagtttttcaagctttagcagatcaggacattcatatcgtttcaagtattccaatcagtcagggaacgattcctccccttaaagaattacaaagttatggggttgctgttcacattggttgtgacaatatttatgattcttggtcatcactgggtgacggctccttgcaagaaaagctcgctcgttatttagagatttttggcgttcaatcacaagaggcattgacccaggcattaggcttggtaacagatggcagagtgccattagatcaagaaggaaatcaacaatggccaaaagttggcgattctgctgattttcttttgacccctgtttcttcaacggctgaatttgtcgcccgcaaaggtcacgtcagctgcagtttctttaaaggacaaccaatctacaacgcataaccaataattattgacaaaaaatgattcggtcacctctcttttgctgatttcgcttgacgctgatccgattattcggtttacttatgatagcgaatacaaaaagtgagggattaccatgtatactgcaaatatgcaacgatatgaacgcatgacatataaccgtgtcggaaaatcaggtttaaatcttcctgcaatttcccttggtctatggcacaacttcggtgatacagatccaattgcgaaacagcgggaaacgatcttaggagcctttgatctaggcattacccattttgatttggccaacaactatggtccccctgcaggatcggcagaaaagaatttcggccgcattttaaaagaagacttacaggcttatcgggatgaattgattatttcatcaaaggctggttactatatgtggcctggtccctatggtgaatggggttctaagaagaatttgattgccagctgtgatcaaagcctgcaacgtctaggcctagattatgtcgatattttttaccatcatcgcccagatccagacacaccattggcagaaacggctcatgcactggacttggtagtacggcaaggaaaagccctctatgttggtgtatccaattattctgcagaacaaacaaaagaaatcgccaagattttgaaggatcaaggaaccccctttatcatccatcaacctcgctacaatatgtttgatcgttggatcgaagatggattaacagctgtcttagaagaggaaggattaggtgcgatcgtctttagccctctggcacaaggattattgactgatcgttatctgcatggtattcccgaagactctcgagcgcatcgctcagatagtccttttttaacagaagatcgtgtagctccaaccttaaatgtagtcagacaattgaatgatattgctcaagagcgaggacaaagtttggcagaaatggcattagcttggctgttgcgtcaagagactgttgctagcgtattgattggtgcttctcgtttgagtcaactacaagcaaatgtccgggctttggaccaattaactttttctgctgaagaactaaaaaagatcgacgaaattttagtgcttttaaagaaataagcgtttgatttgctcgctggcctttcccatgggggaactgccccgcattgagtaaaatggcggaaacttcatttcaaacaacaaagaaatcaaacgaccgcagtgtgtattgtccagaagctattaatgcttcgatgcaataaccctcgcggtcgtttggttcttttttgctacattttagttgattgattctttttgccaatcaatggctaattgcaggcagcctttgatgccactttcattcactagttgccatggaacaatgtactcttctacacttggaatcgaaatgtagccccctagttccagcaaaaattgttctctgatttttgacagcaagtgggtctgattcatgacaccaccgcctaaaataatcttatctggtacaaaggacaatgtataattgaccaatgcttgcgctatataataggcttgcagctcccatacaggatgattttcaagaagagtctctcccttttgccccgttcgtgcttcgatggaaggaccggcagccagcccttcaaagcaatcctgatgataagggcaagtgccgacatatgaatcctctgggtgccgtttgatccggatatgccccatttcaggataagatttgccttggaataactggttattcacgattacgccggcaccgatcccagtccccaccgtcagataaatacaggtatcgcagtcttgagcagcccctttttttaattccccataggctgctgcattgacatctgttgtccaaaccattggaatcggatagcgttgttttaacgtccccaaaaagtcaaaattttgccatcccgctttaggtgttgccaaaacatgcccatagttggcttgcttggggtccaatccgattggaccaaagctgccgatccccatcgcggccagctcatacctatcaaaaaatcggaaaatttcggccagtgtttctgcgggttctctcgtagcgattcgctgtgaagcaataatcttcccctcttgatccgctactgaacagttcatttttgttccgcctgcttctatgcctccatacatcattgcctatccctacttttctactcgaatatcgaaataatccattactagctcacaaaacatcatgtttgcccaagaaaaccattcacgagtgtaatccgttggatcattgacattgataccctcatgcatcaaatgcgttcctgcatcgatcgctaccaactgatctaaaatttgggctttttcttctttgtttggtgtcgtcaatccagtcatcgccatcgcgatcggccaaacaaaattatgcggtgtatgagatgagccgatcccactagcaaattcgccttgatagtaataaggattttcgtcacttaaaagtgtttttctcgtagctagataagttggatcttccatggagccatagcctagataaggtgcagaaatcaggttaggtacattgctgtcgtccatgacagaggcattgcctaacccatccacttcataggcatagatcgtttcgccagcttgattcgtcgtatacgcatatttttcgatccccgcttggatctcttgctttaaatcggctgcttcggccactaattcaggcacatctaaaatgtcggagaaaatcagttccaaataacctaatatcacaacagcgaacatgtttgacggaatcaaatagccatagacacaagcgtcgtcgcttggacgaaatcctgaccaagtcatcccagttttagcaactggggttcctttgccggcgaacttcagcgtatcttcttgacgttctgtttggcgctcaaattgatatggtgactgcgcgtgatcttgttctgtccgaaagacggttaggacttttttgaccccttcaataaagtttttatcaaagtgatcggtgcgccaggtgtttttataaagtagataggctaactggatcggatagcacaatgaatcgatctcatatttccgttcccagatccagccgttcatttcggttagatcatcttggtgtccggcaaaattttctgtttcattgaaggcattggcgtaaggatcgatagtgataaacataaattgctttttgactaatccggcaatcatatcagacagttcttgatcatcttttgctaaacacaggtacggacggacttgagcggttgaatctcgcagccacattgcaggaatatcacctgtcaaaacaaaggtactgccatcttcttgcttcttgacagtggttaatacggtattggcaaatgccgcattaaagttttccgcccaattttcatggtcttcgccacaaagcaacgtgattttctccataaaactcttaattactttcggtatttcgctgtatcccatcttcttttccccttttacaaagaagagccgacaaaagtagacaaagccgctggtctttctgcaacgagaagcttcgggtagttgatgttcaagactgttcaatcctccatcctatgcccgatttgctaagaatgaaccaaccttcgctgatcttgaaaatctgctgccagtcctttcgctttgtctactgatatttctcttcaaactttaaatgattgcagcactttctaatgccatgacccctgataattggtcagacaagaaaacactagttggaatttctgcgactaaccagtctcggtaagctaacagatgtccttccttctgactatgctctaacaagcgttcacagctggatgtcacaaatcctttgatggaggctatgtctaagcccactttttctgcttctttgactaagagattcaaataacggtattcaatgcctttgaacaatccaatgtcaccaccatctccttcatcattgaagaccccatctttaccaataacttcaaaggatgttttggcacaagtgattgcatcttttaaataagaaatatcgtcagtcacatgataaaattctatcaatgctccaatatagaccccttggttgtaagtaaatttccattgcacatcgattttgccatcgccattacgattgataccatcttctacgaattgtgtgtccggctgtaccaaatattttttcatccattctagtgtctgttggcttgtagtcagatagcgttcattggcttcaacttgatacagacgtaatgctagaataataattggtgcatttacaggtgtattcttatagtcaagctgcgtgcgtttccaagcaaatccgccattcatatgatcattccaagcagtatcaaaaatatccagacatacttctcgggcgtcagctaggtattcttttttcttagtcaagtcatacaaacgtaatccagctaatgcgttccacaacatgtcatcataaaattcatgcagcaatgtgttatggtttcttgctttattgtaatgataggtttcttctgcttgctgcaagtaagccatatcgttggtccgcagataagcatcaatgcgtacatccactaaatgcgcgatccaccagtaattgaaggtttcattttctttctcatcccgcaatggataaacgttgttcataaattgttctttggaagctgcttgatagaaataatcgatacttgtttgtgcaagatcggcatacttgttaaaatcggtcattctcctgatccttctttcaatattttgtcaccttgttgttgagcattttctagtgctttttgcggcgttgtttttccagaaaagacattttctaattgtggaataagggctagtttttcgacatcggaataccccataacagttggtcgaattttagcaaaatccatggtttccacaaaagctttgtacttctcattttcagtaaagtaggtattttgcgctgcttcgatatttgctggtagccaagtggaaatttttgcaaactcgacaccgatatctgggttggtcgtccaccatttaataaagtcccaagctgcttcttggtttttggccgttttgggaatcactaaaccaaagccacccgtcaacgcccctttgtccccatttggtccagttactggagggacgaccccataatccaagccattcactttatcataatctgctaatgcccaaggtccgttataggtcatcgcaactttaccagctgcaaatgcatcagatccatcattaaatccttgttgatagaccttcgcttgattcattaattgatcccagaaatcaagaacggtcattcctgcctcagaattaaaagcagtggcagtattatcagcgttcagcatggttccgccagcttgctgcaaccacatattgaacaatccaacgtcatcaagagaaaaaccagcttgcactaacgtttttccatcccattttgttgttttcttcgcaacatccaacaactcatcccaagtctttggtggttctactccagcttctttcagtaatgttttgttataaaagagagagcggttgtctactaaaagtgggattccatattgtttattgtcgtattgcatttctttgacagtttcttcataaaaatcgcccatatctacattgtcttttttgatcaaatcatctagatccaataaggcattttttttggcatacatcgctgtattgacgcgatcccacaagataacatctggaatttcgccacccgccattccggtcagcagcttttcttcaacgttgtcttgaactttgtaggtcacctcgtatttgtcttggctatcattgtattgatcgatcaattgattgagctgatcgacttggtcaccactccaagaaccccaaaaagtgattttctgctttccgccagctccatcattgcttgcctgatcattgcctccaccacatgcacctaacactgtcatcgctgctactaacagcaatcctttgattatgtttttcatcacattcactccttcgttttatttgataccggcatctgccatgccttgtacataatttcgttgtgcaaaaatgaatagaactaaaacaggtagtgttgccaaaatcgttcctgccatcaatggaccataatttgtattgtagttgtattggaaagctgccagtccaacttggaccgttttcatttcatctgcattcaagacaatcatcggccacataaaggcattccagcctgcttgaaaagtcataatacctagcgttgtcaaagcaggttttgctagcggaaaataaacattccagaaaatcttgaactcacttgcaccatcgattcgagcactttctccgagttcttttggtaattgttcgaagaattgtttcataaagaaaatcgagaacgctcctgctgctccgggaagcaggattgcccaataggaattgatcaatcctaacccaccagtaccagttagatcattccctccagccaacgggaatccgcgaagcacaataaaggttggaatcattgtgacaatacttggaaccatcattgaagctagaaaaacgagaaagattggtttcttccctttgaatttcagctgaccaaaagaataaccagctaatgaaccaaaaaataaatttgtcgctacacccccaagtgctaatatcaatgaattttttaaatagtttaagaaaggcatcgtttcaaaaacttctttataatgatcccaagtaaagtggcttggaatgatttgcatcgatccgctgagaatctcgctatcggatttaaaggatgtcgacaaggtccagataaacggcagaaccgttgtcaaactgatcagaatcaccaagcaataccagatgaatgactgcatatgttttgttttagccatcgttttttctcctttagtttgtttctgtattggtcaaacgcatattcaccagtgaaaaaatgaaaatgatcatgaacaagataaatgacagcgcagaagcataccccatttctagtccaccaaatcctttattataaatatagtaaacaagggtgattgtggaatttccaggtccgccttttgtcagcatataggcttggtcaaatacttggaaagcgccgatgatcaattgtgtgctaactaagaatgttgttttggataattggggccaagtgatactcttaaatttttgccacgcatttgcgccttcaatatctgctgcttcataaagagcaggattgatcccttgtaaacccgccaagaaaatcatcatgtttccgccaaaactcatccagacactcataatgacgattgcagtcattgcccaattggaactatacagccaagctggaccattgattccaatcaaactaagcaactgattgagcaaaccatactgtggatttaagagccaataccaaatggttgctgtagccaccgatgaacataagactggcaaataaaaaaatgttcggaaaagactggtggtcttcattttgcgattcagcaacatggcggctgctagagagacgactaatcccaatggcacatacagtaaggtgtagacgatagtgttctttaatgaaataaagaaaaattcatcttgaaagatacgcgtgaaattctttaaaccgatccaattggggctttcaatgatcgtataatcggtaaaactatagaaaagtgccatcactatcgggataattgcaaaaacaactagtagaagaacaggaaccagaataaatacataggcaatgttttgctgttcattgatccctctctttttctttcctaactccatttattaacccccttattaaatataatataaaactatttaatatattaaatatctttacaagcgaattatatagaattaaaaagaatatgtcaacggtttcataaaaagtttttttgattaaactgcttgctttattaatataatatatttaatatatacataaatagttcttttattttttgagaaatggaggcgcatgcatgagtaaacctttgtaccaaacgatttatgaagatttgaaacatcaaatcgaaacaggcactgtcgcaatcaatgacacactgcctactgaaaaagaattatcaactacctatagtgttagtacgatcacggtcaaaaaagcactggatctgttaaaagaggatggctacattgtcagaaagcctcgaaaaggttctgtcgttgtcacaaataagaaggcagacattgttccgaacaaactcattttcggattgatcatcaccaactttacagacttttttggcgctcaaatactgcgaacagttctagaaacaaatactgaagaaatcaatttcatcgtcaagatcagttatggtgatcctgatcgcgaaaatgagttgatccaagaattgattgaaatgggcattcagggtttgatcctactgccgacatcatcagaatatacctcgccaaaaatcttagaattgatttctaaaaatttcccgatcgttgtaattgatcgtctgatggcaaatttgccgatctgcagtgtgcaaacggatagctttgctgctgcaaaagaattgacaaattatctctttgccaaacaccatgacaagattggcttgattacttccgatagcagtgtttcaacgattgatgaacgagtcaatggttttctctctgcgcatgtggatgccaaccgggctgtcagccaaaagcagatcttgtcgaggatcgactctgtggtccccagttcttctcgcaagatcgaagatgatgtggcacttatcgtggcctttcttcaaaagaacccagagatcacagctctttttaccacagaatacaatattgctttacttgccaagagtgcgattgaacaattgggaaggcaagtcccacatgacttttcagttgtttgctttgaccatcctaccgtcaacatttttgacttgaatgcttttattttcactcatatcgagcaagaccaaacagccatcggcaagcatgccattgatcttttactgacaaaaattgctcatcctgatacgattgaaaagatcaacctcggctatcggttgattgaaggagattccgttatttctagatgatcgtctgttcctctatcgaagcagtacattagcgatccgactacaaatagacaaaaaaacacacctccgttctgactcgctgaacgagtcagaacggaggtgtgtttattgggatagctgtcattctttaaactagacagtcctccttttagttattctcgatgactgcgacttcttttcttgtaggcatccccgtttgggcacctaatttttgaacagaaagtcctgcaccaagattcgctaaaacgaccgcttctttaaatggcaccccatcacttaatgcagccgctaagataccattgaaggtatctcctgcaccggtagtatcaacgacggtcactttctttgatgccacggtcacgattttaccggaatcaacgaaacttaccccttgactgcctcgtgtcactaccaatttggtagcgtgcgtttgctgccaagctagaatcgttgcttcgatttcaggttcagggatcaattctttaccgatcaatgcggcaaattccgtctcatttggcgttaagatatcgacataaggcagtaattcccctacgatatcatgataaggtgcgggattcagtagtgttgtcacgccattttcctttgcgagctgtaacgcataccgaagcgtatctaccggaatctcaatttgtaccagcaaaacatcgctttctatgattttatcagctatttgatctacatattcacgatctatcagtccattggcaccggagattacagtgatgcaattatcttgcggtaatttaaaaatacttgcgataccagtaaagatatttttttcttgtgcaactgactgaacatccagttgctcttcacttaagtgtcgatagactttttccccaaacgtatcttgaccaatttttcctaagaatgtcgttgttccgccaaaacgggcggctgcaactgcttggttggcccctttcccgccgacaaaataatcaatttgatctcctatgatcgtttcgccaatttttggcattcgcccagtcgtgataacaatatccatattcacactgcccaaaactgctattttacccactaaatcacctatttcttttgtatatatagaacgggccaaacgcttcgcgacccgtaacagaagttgtctctatcaaagaaaaaccggttttctcaaataagtgctgcatcggctcattcgtatggttggtcagagaataaatggcatcccctgctttacaaaagtctcttagacaagttttcacccaagccgagcccaacccattccccatttctgatgcttttgtcacgagcctttggatacattttgtatgttcattatacccatgactctcttcgtgcgccaaaaattctggactaagggttcctgcactaacgatttctcctgattcatttttatgaatcagtaattgttttttacagatatctgttttgacgatatccttatcagggtaactgcttgtccattggcagatcccctgtgtctccatatttttttttgcatcaacaaacaactgccaaatttcatccagttcttcattgcatgcatatattaacttatccatcaaatcaataaggcagtaacaacagcgacaagacaactactaggataattcctatgatcgtaggaacactggtccgtttcagcaaacgaaccggactcacaccaatcgatgacgaaacgatcatgacaactgctgcaactggtgaaatcgtccgcgctaagttagcaatcatttgcattggcagcgcaatcaagataccatcgataccggctttttgggcaatattgggaatcagctcgatcacagcatagaacatggctaatccaccaccactcaaaataccaaataacgctgtcgcgccactgaaaatcagtgtggttagaacaccggcagattgagagttttcaaccgcactcatcaaagaatcgatcacgcctagactttgaatcgctgtggtgaataaggaacccccgactactaacataacgacttggctgaaaccttgtcccattcctttgaacagttcgactgcactttcttgggcaatcttaaatgatttcttacggaacccttcaatgatcaatgctacgaagaatgagatcattgtcaaaacaaaaatgtccatcgtcacattttctctaaaaataccaataattccaacgataatgatcaagactaaaggtaataatggcaaaatggcataaaatgtcgggacaactttttcatccgccgcactttcaacttctttcatctcgacaaacgcttctgaaccttcctttttatcgcaatacgtttgccagaagtagtggacaacagctaaaataagtaaggttgggatcgagaccttcgcatgatacagcacataagtcagaatgttgtaatccaacgtttgtgcagcaatcacattgtctgctcctaatggtgttggcatgatcgttgcggtcattgcaatgacccctgctgctgtcattgatgaaattccaataccttgtaagagcggatacaaaatagccattaaaataattgctaaactagaggcacttggaacaactagagacatcaaatttcctaacaggaaaacaatcggtataaacaacgctttggatttgattttggtcattggcttgactaagatattgaccgctttttgattggcaccaatcaaattcatatagccggaatagccaaataaaatcatgatcactaatcctgctgagctaacttgtgagatgatcgtgtctttcagtttcagaaaaatatcaaagaaagccagaccagttccttctccttcaggatagagaggatttcccaatgccaccgacgcacctaataagacaatcgcaccgataatcaaaataagcgctggattataactcttaataataaaataaccaacgatacctaaaacaactaatactaaaattgcttcaatcattttttcccctcctatttacactgactgattgcatgtaaaaaccattccttgaatttattctcatcgacatcgacacagacacggcaattcttttctttgccaagtttattgttcagatcgatgatcgtagcgccagaagtatactccccttttgtttctactgcgacaaaggtttctttgatctcaaacatttccggacaaagaacgtaagctaaagcacagctgtcgtacatttttaatccggtaccaaaacttccacctcgatatttcttgaaaaggtggtacatcatatctccagtttgattcatgtctttgattttttcgctgtcttcaggataaaccagtgctttcaacccgacatctaatggtgcgcctgctagcgaaagaccgctttcaaaaacgattttggctgcttccggatcaatcgcgatattgaactctgacaaaataccaaagtttcctctgcctagcgcaccacccattaaaaccaattcttcaattctttctttgacttcaggatgcgttttaagaagaagtgcaatattagtcagtggtccgattgcgataatcgtcatcttctctgcagaagccatcaatgtgcgatgcatggcttcaacggcactctcttccaataaacaactgcgatttggtgttggaaactcgtaccctgccattcctgttacaccatgaacatcgctggcatcttttacttcacgaagcaaaggtccagctgcgccttgggccacaggaattttcaagttccaaaaagtcagcaacttcaacatattttccgtcacatatttgatccctacgtttccagcaactgtcgtgattaatttcacgtctaactgatcactgaacaagccaattcctaatgctactgcatcgtcaattcccggatccgtatcaataattactgctttgttcataagtaaacccctttcgttttttgataaaacgttttatcaattggctaaaaataaaaaacgtttgataaaacgttttatcatttgttctcccaaagaataccacttatgtaaagcgctgtcaataacgaatacaaaaaagctttccataaatttgcgctgaattctaacctagacaatcgttgtgttgatcagttaaacagctacgtcctgatataaacacaacgattacctttttcattctatctttgattccaaccgtttgccaacgcttttttttcgtacgatttttggcgtcaattgaagataacgcggcgcttgttctttcatcgctgataataaagaagcaactgctttttcccccagaactgtcacatcttgttcgacagaagtaagtggtacttctaataaatcatttaaaatcaaattatcatagccaacgatggacatttcttctgggatattgattcctaactccttggctcttttcatgatccctaaagcaatcaaatcatttcccgccacgataccggtgattgcttgattgttcaaaagctggtctgctttgtcataggcatcttcaaactgaaattttgtgaccacccgccagctttcttgctggggcagctgcgcttctttcagagcatccagatatccttggtagcgataaatacagttgatatttttatcggggttcatcataataccaatgttttgatggccattattgatcaattccatggtcgcaagatagccgccttgtcgattattataaaacacttgtccaaccggaaaattatccaaccctcgatcaaccagcaccaatggtacagaaatactgcttaaaaactctttcaactcttcttcgtaagtataagattcactcgaaagggctagtaacagtccatccacattacgatcgatcaataattgaatcaattctttctctgccgcaaagtgatcatctgaattgactaaaatcaaaaggtaaccaatttttcgcaactggtcttccagtacttttgctaattgtgcaaagaaaggattattgatgtctggtatgaccaatccgatcgtatttgttttgtttagcactaaactttttgccgcaatattaggcgaataattattttccttcgctaattgtttgatcaagcgttttttcttttccgagatgcgaatcggtttgtcatttaagacttgtgagacagcagcgattgagacgcctacttcttcagcgatatctttcaagcggatcttcactcttcttctcctcgctttcctgttttattctacgccagtccttaaggttcgtcctttctctattctatcatagctctgtttatgtaagacattcagagtcaaacgattggctattttttctgacatgagtatttggaattcgcctacgtaaagagcgcctattgcgtttttaaaatacagcacccatgaaacataacaatgaccggacgttcttttgggtttcgagaagtccggtcctgttcttttacacgtttccttagtttaatcattctttgcgtgagtgatcttggttctaactaaatattaaatcgaacccaatcggcaaaaagctcgggccaacgaaccaccgagtcttcaatggcgtgttcgccaccactggccgtttctttggttccgagacttagaccatgcccacctctaggaaaaatgtgtaattcataaggaatgtcaaacttacgcagttgttttgcaaacaagagactgttttctgccggtaccagaccatcttccaatgtgtgccataaaaatgttggtggtgtgttgcgacttacttgcttttcaagggaaagctgcgccttttgttcgtcataacggtttcctaaaagagcacggaaagacccttcatgagcaaattcaccgcttgaaagaaccggataacttagcaacaacccatttgggcgccattcgtgattggctcctgacaatgtttctgttaaaaagtcttcttgccaaaatacgcccaaacttgctgctaaatgcccaccagccgaaaagcccgcgacaatgattttctccggatcaacgtgccactgtgaatgattttggcgaatcaattgaacgctcgcagcaagctcttgcaatgctaatgggtacacatggggtttgatactatagtggagaacaaatgcctgaaacccaaaactcatcatcttgattgctatgggttcagcctcacggtctgataaaaactcatagcctccgccaggacaaataatgattaccggtcgcaaccgatcctgctccatctcttcagagttgtcaatcacataggtagtaagcgttgcttcacttttagaaaacggttggatcacttcatggatcatagtaattgcctcatttcatgataattttgctaacaactggttctttgatttgtagatgagtatactagatttttagaccagctgtagttacttgtcaagtcaaggaacgatcgatggcgaattcctcttgtttttttcaaaggggttgccgacaatttgagaataggtatcccagatcgaaagtcctttgccccttcattccaggctccttcaatcttgtacgcggcagcaatcgccccatgaaaatcccgaggaaaaagaatcccatttgctgtaagacctgttcataatccttcccagcaatcacaataaaacgattacatatgatcgtatcatattttcaatcatacataacagatttttgtttttttcataaaaaaaactgtggcataagttgaacaaataattacccgatcagaagggtcgcctcctgacgaaaatggtcgatttgcctcaaaaagccataacttgctgacttctctggtagcaattaggtagttatctgtttcggcttatgtcacagcctatttcattaaatcaagtaatcattcaaacgagatttcacgtattcaatgtggctagattccagctccacttgatcatgtgccaatgcgtaatccgttaagctttcaagatcctcctgatctgccacgatctttgcgccgatccctacgttaaatgaggcatagcgtttttccttcaattcatctaagaaacgatcttctttgatttttgctgcggctttcaatgctcgtgcataggtatccatcccagcaatatgtgccaatagcaagtcttccatttcaaaagatgaacgacggactttggagtcaaaattgataccgcctggtgcgataccgccattttccaatacttcgtataatgccagcgttgagtcaaaaacattcgttggaaattcatcggtgtcccatcctagaagcatatctccttggttagcatctaaagatcctaatgcattatagctacgagcaacagcaatttcatgttcaaacgtgtgcccagctaaagttgcatgattggcttcaagattcaacttgaagtcgccttctaagccataatgttggataaaggccatcgtcgttgcggcatcaaagtcatattgatgtttcgacggttcttttggtttaggttctaatagaaattgcggtttgtgaccaattttttctccataagcaattgccattttaaataggcgagcaatattgtcttgttcgaatttcatatctgtgttcaacaacgtttcgtacccttcacgaccaccccaaaagacgtagttttcgccgcctagttttttagagatatctaacccttttttaacttgggcagctgcataggcatagacttctgcattgttcgttgaagctgcaccgttgttaaatcgtgggtgagaaaacatattggctgtgttccataacaatttgatgcctgtttgatccatcttttctttgatcaggtctgtgatcacatctaaattttggaagaactcctctaaagtttcaccagaaggtgctacatcaacatcatggaaacagaagaattcagcgcctagcttctcgcaaatttcaaagaatgcttctactcgatttttcgcggtttccatttccgtttcaccgaaccaagtgcgctgattgaccggtgccccgaaaggatctgaaccatcttgtgtcatagtatgccagtaggcaatcgcaaaccgtaaatggtctttcattttcttgcctaggactacttcttctgcatcataatgccgaaaagcaaacatattggccgtttctggaccttcatacttgattttatcaatcgttggaaaataattcattttggttcctccatttttagttttttaacataacaaactaacttacttctaaaataagttacatgaaacctttagtagtggcgattctttcgttgattactctgactgcaatgctgccaattcgcgacaaagaggtgctgtttgttgatacactttatgataaacagaataaatccgttgatactccgttacattttctgcgattggctggattactgacccatactttacaaaagccttcacacaagccgcttcgtcaggataaagtccgcttccgattgccgctaacatcgcggcccccatgccgggaccttgctctgtggataatgttgtgatctctgcagcaaaaatatccgcctgcatctgaagccactctttgtttttcgcacccccaccaacagaaacgattttgctaaatttccgttttgcttcttcttccatgatcagttgagagtctttcagagaaaaagtgatgccttccaagaccgctcggctgaaatgccgacgtcggtgatgggtatcgatccctatgaagcttcctctgacagtgctgtccgtataaggagttcgttcaccaacaatataaggggtgaacagcagaccatctgctccgggagaaacctccccaatatctgctagcaattcggagaagtctactccttctgcgaatgtatctcgataccaacttagtgagttaccggcagctagtgtgacacccatcgagtattgtttttttgccactgcatgattgaaaacatgtaatttcccttggtaatcaatcttctgcgcttcaaaagataagaatacaccgctagtaccgatcgataccatcccaatgccttcgtcaataatcccagatcctagcgcggcacatgcgttatcggcgccgccagcaaagattttgacttctttttcaaagccaaattctgtttgtaaatcagggaccagtgtcccgacttcagctgctgattcaaaaagtgtcggtaagatttcttctggaatagcaaacttgttgaggatttctgcagaccaacagttcttctcactgtccagtagtaatgtcccagcagcatccgaataatccattgaataggtacctgatagccacaatgctaagaaatctttcggcagcatcaagtgctggaccttctgccaattgtcaggctcatgttcttgaacccaacagattttaggtaatgtgaatccttctagtgcaatgttctttgtgattgaaagaatctctggcatctcttccatgattcgctgacattgcttcgtcgtccgaacatcgttccacaaaattgctggtcgaatgaccttgttttgttcgtctagcaagactaaactgtgcatttgtcctgaaaagctgatgccgatcaattctttgcgcaactcaggcactttatcgatcaacgctttaatgactgcatgagccgcttgacgccaatgattaggatcttgctcactgaatccaggtcggggggacgacaatggatagtctgcactagcagtgtcaatcagatttcctgattgatcaaaaaccaatcctttcaaagaactcgttcctagatccagtcctagtaaataagccatattcttctcctttgctactgatgaaattcttatttgttatggtttacaaaatattgcttttaggttaatttgcttaaaaaactaactaattggatagtaaacgacctatccatttttgtcaagcgctttcaacagttatttgagacttttttaagcacctaactgaggaatatctccttttacagataaacttgcactttattaatttgcacggtaaactaacattactatagacgaagaaggagatactatgattattaacaaaatgggcatccgagagcagaatgaagctgccgtcctgaaaaccatcattgataacgaacatatttctagagctgaagtttccaacttaacgaatcttaacaaagcctctgtttcgcaaataatgaaaaaattgattgaaaccgattttgtcaaagaagtaggaattggtgattccacatcgattggcggacgcaaacctatccagcttcagttcaatcatcaaagcagcttagcgattacgtttgatattggttataattatgtcaatggcatgctatcttatatcaatggtcaacgaatagccattttggaaaaacaagatatcttgattacaaaagacaacgtattcaccacgattgattcgataatggctgaatttacccccaagatgcctcctactacccatggattggttggtatttgtttagcgatccacggtatcgttaatcaggagaacatcacttttacgccctattatgatctggaacacattgatttggtctctcctcttagtcagaaataccataccgcagtctatatcgaaaatgaagcaaatttgactgcattaggagagtattgcttttcgtctgattcaactaatctgctcagtgtaagtattcatagcggcatcggtgtcggcatcattgtaaatggacgtttacagacaggaactcacggaacagctggagaagtgggtcattctacattgttccctcatggaaacctttgtccttgtggaaatcgcgggtgtttagagcaatacgcttctaataaagttttattcgatacctacagtcactatacaaaaaaagagcttgtcaattcagatatttttgcaaaggctattcgttctggcgagaaatcagcgcttgaactagcacaacaaaatgtcgaatttttgagtatcggcttaaataatgtcattacatttttcgatcctgaagaggtttatatcaacagctctgtctatcgcaaaatccctcaattgaccaaagacctgcaacaaaaattaaccagtcagttcactcagaatacgaaaatcaaaaacagtcgtttgggcgaacaggcacctctgttcggtggtaacgttctgattgccaagaacttcttaaacattgaagatctgcgctttccaacggttgatttcctttaatccataaaaatttttttctgatacagaaaatccactgattcatttagccaccgtataacttcaataagtggcaacacaacaaatggactgggacataagtttgggtaactgactctcgctgcgctgcaggagtactctgtgctcctgcacaatttcatacgtgttctcctgtcagatactttggttatcattctttatttttccttatatcatacagtaccagcaagacaatattgaaaccccctcatcaatcccttctcccagcggcttactcttttatgtctcctgcagtgatcccgccaacgatatatttcgactgcaatcatttactcctattcaaaatcaaaaggtctcttccccttctaaaaaaggaatagacctacaaagtcagaattgcttgaattttccccattgcttttgatcattactcatcttggttctttagttttgtcttttttagtcttgcccttattggaaggcttgattttccttctgatacaaaaagaccgaatagcgttaacgtcacgcctagtagtttcactaaactgatcctttctcctaggataagaaaagaagcaaataatgtcgtcacaggaaccaaataaatatagaggccagccataacagcacctagctgttcgacggtgtaattccatagaacgaagcacaacgcggaagcccccagtccaagaaacagcagataaagcagattgtccgtttgaagcaatttatctaacgaaagggaacttttcgtcaaaaagaacagcggcataataaatagaatgccatataggaagatcattttcgtcgtgtcgatcacggaatgtccccaactagcgatctttttgaccaacagtgaatagaccatccacatcagggcggctgctatagctaaaaagtcgccaaagggatgaaacgaaagatttcctgcaaagctgatcagaaaaataccacaaaaagaaagcaaaaaaccaataaagaatgttccctttaatttcgttcgataaatgagagcagaggctaagccaatgaagagtggagaaatggaaacaatcaccgcaacattcgatgtacttgtataacttaaagctatgttctctaaaaagaaataaaaacaaacgccagatattcctgctgccatcaaataaagatgttgacgaaagtgatagtgtatcctgctaaatttggataacacactcaacgccactagtccgatgataaatcgtaaaaataatatcgccgtgggtgaaaaatcaatcagcagcagttttgtggcaataaaagttgttgaccagaagaaaaccgtgatcaaggcagtgacatggggattcttaaataaatgattcattctgtactccttaaatacattttttgatattgttttggtgtcagcccaataaagcttttgaatacattggagaaatgactttgatcggagaaattcgtcatcaacgctacttctgataaggactgctgttttgccagtaatttctttgcttcatcgattcggatcgataacagataccgataaggtgtcatgccatagttttttgtaaattgatgaatgaaagaactttttttcaaattcgtcaacgcaacgagattctctaaacgaatgtcttctgtataatttttttgtaaatgatggcaaacattttctaacaggacattttcaacgggttcattctgatacccttctgctgtataggcaagcaagttttcaataagcaaatacatcaattcctctcgatatagaggtgatttctttgaaagaatcgcttggtacaattcttcgactagttctcctgtgctattgtttcgcaggatgacttgactaaaataaggcagatcctttttgccggtaatttcttttaccacttgtgtcattgcttgcttggaaatgttgagggcgtggtaggtgatttcttggttctccagactttggcagctatgaggctgatagggattgaataaattcagatcgcctttttcgaggatttgtgtctctccgcaatacagctttcttcttcctgctaacaaaatacccactacataataatcatgaaaatggaggggaaagctcttttgatacttttctaacgcataggcctcaatgccaactatttcatcatagtgaacctttttcatactgttcctccttttctatctattttagcattgaacctttcgatttcttgtaaaatattccatgcttttctcggaatcatcctacatttaacctttccagaccctatttatgaaccaacgaaaaagcagataaaagaaagatcgcctttcctctatctgctttaattgtttgatccgctcttctagtttggatttaccagacattttataggcgcacgctcacggaaaaatcatccctcaaagccattattgtcagagacttgcttgaaccaatatcctgatttcttgatactccgtttgcggtcattttctaaatcaacagaaataaagccatatcgatttttgtaagcattggtccatgaccagttgtccatgcaggtccacatgtggtagcctaggcaatttgccccttcttgaattgcttgatgaacatatttcaaatgctctgagacaaattcaatccgatagtcatcatgaatcatcccatcttcacctaagaaacgacgttcattttcaacccccatgccattttcggagataaagcacggcaggttgccatagttatcccgcaggttgatcaggatatcgtaaatgcctttttcatagatttcccaaccacgataaggattcatttttttgcctggcatatcatacacatcaaaataattttctggcattggctctgctgcaggatcgacaggcgtttctttcgctttgatccgccgtggctgataatagttgacccccaacaaatcgacagtattatttttgatgatgtcgagatcgctcgcttgcatctcaggtaccatgtctaattctttcacgattttcaccagttcttctgggaaaattcctttgaccgcaggatcaagaaatgaacgattgaaaaaagcatccgcgatttctgctgctcgaacatcttcgggattattactgtctcttggataacttggagttagattcagtatgatgccgatttgaccagtttgcccactttcatggtaagccttgatcgccaaagcggaagccaatgcttcattaaatccgacttgaatggcatgtttcatgttactttcttctggataatgcaattgatacaaatagcccgcctcaacaggaacgatcggttcattatgagtaaaccattttttgactttatccccaaacaagtcgaaacatgtcttggcatatctggcatatgcctccacagtctctcgctggagccagccgcctttttcttgtaatgccattggcatatcaaagtgatacagattgacaaatggttcgatcccattgttgatcaattcatcaaaataatcattataaaaagaaacagctttaggattgactgcccccgttccatcaggaatcaaacggctccattgaatcgaagtccgaaaagagttatggccggtttcaaccatcaattggacatcctctttgtagttgagatagacttccgatgctttgtctggacctacttgatcaaaaaatttttccggttctttggcataccagtaatcaaaaatattctcgcctttgccgtccccggctacccgaccttctgtctgtgggccgcttgctgcggaaccccaccaaaaattttctggaaattgaaccttcatgtttctgctcccttcggtaatcctagtaattgattttccattaagaccacttgtttttcagtggccgcttttcccattttgattcgttctaagacaagttctgcggctttctcccccattttttctgctggcggattcacagttatttgcggcaacaaactctgttctgcttcagaaagataatcatagtgaccaaaggcgatatcttttccaacgatcagtctcttttgattgaaacattccaaagcccccactgacatgttgtagttactgacaaaaattgcagtcgctccccatgcgactaattcttcagttccccgataaccgctttgtcttgtgtagtcccccaccacgattttcatttctgcttcattgtttgccatagcagcttgcgcaccaaacagtcgttctctcgcagtgtgatccgactgtggggcggaaagataaccgatttttttatgtccagctgctaaataatggttgatgacgtcaaaaacactttgacggtcgttcaataagagaacatcggcgacattggcgatatctggactgttcaaagatataatcggcacatggatatgtgttaatttcctaatatctgtacattcttcgccagataagaaaacaatcactccatcgacagcgtgtcttagcaagtattctactttttcttcattctttttcgaactattcgaaaacccactgagtaataaactatatccattgtcctcagcaaccttttcgattccagatacaacttccgaaccaaatcgactggagatgctattcattaaaagtcccaatgaaaaactgcgattattttttagaccctttgcgataatattctctttataatccaaagtatcaatggcagaagcaattttttccatattcgattgtttcagttgctggccattcaaataacgtgatacagttcctaccgaaacacctgctagttgtgcgacatctcttattgacgccattttaatctactcctactattcgagatcgatttcttttgcaagatctccaatcatgatttttacttttttaacgtaatgccactggtcatctgcacccatatatcgaaaatcatcagatgataaagtaaatacaattgttttttcctcttgaggttccagctttaccttacaaaagtctttaagcatcttagtccgttggataactgaccctccaagcaatttaataaacaaaagtgtactcactttgccagcaaaatcacctctatttcttactttaacggatacttggagtttgtcaacattccttttataagcaagtgattcataagtaaatgttgaaaagcttaatccttcgccaaactcatggagtgggcttccaggtaaatcatagtagtcctcttgtttggacgcatctcgttgataataatagacaggaagttgggagctgtttcttgggtaagtgatacctaatcttccacttggattattttctccaattaaagttttagcaattgcctgtccacctgcttgcccagggaaccagccaactaggacagcatctgagcaatcctctactagagttatatcatagggtcggccctgaataagaactgttacgattggtttatccaatactgataatttccttaacaatagctcttgttttcctcccaatgaaagagaagcaacatcaacattttccccagaatccatattaattccctttgatgagacagcaccatttttcaaaaattccatatcgaaatttcgagcactagaaccacctaaaattgtgatgataatatctgcatcttgcgctatttctattgcttgtttaatttttagatcttgatcttcttcgtttctgacttcacacccttccgcatatacaatttctgcatcaatcattgtatcttttagtgcttgcacaatggttttcttttgttggtctctcgtttgaggagcggagtagtccccaagtaaatgataaatactctcagcattgggacctatgactgcgatttttttacctttaggattcaatggtaggattccattatttctcaaaaggaccaaactctctttggctacttcttcgttcattcttcttgatgcttctattaataatttttgatcagtaggttggacaaagggattttcaaataatcctaaaagaaattttactgctaatacacgactaaccgcatgatctaaagctttttcatcaatggtatcatttaagataccagattcgattttagtataagtctcatcccacaagcttagatctacccctgcatttaaagcttgtgcagctgcttctacctgatcttcatagacatcactgagtcgatctaatgcaattccatcagccataaccagtccttgaaagccgttctctttacgcaagtgttgttctaacagtgtttgatttacatgacatggcacaccatcgatatcattataggcagccatgactcccactgcatttcgtgcactttttaaaagcggcatataaatgtctgcaaattcccttttacctataggaacggttcctgaattatgtcctcctaatgcatctccctgagcaatacaatgcttcaatgctacgccaatttgatctggacttttgttgatatctgaaacacgctgatctaggaaattaatctcatctgagatcaaacttccttgaaatcctttaatcacagcttcgctcattcgagcactcaatataggatcttcaccaaaacattcttccgatcttccccatcgtggatctttagctagatcaagtgttgagactaatgctatgtgaacaccttttgccgccaattcctgagccatcaaatgactggtctcttctatcaattgcgtattgaaagtacatccgcgaccgatattcgttggataagaaatactatctaatgcttgatgaccatgaggacattcttcaacgatcaatgcaggtattccccatcgtgaatgactaatcacgtaatcttggatttgattgaccactttccaactttcctgagcgggaattccatttttgtaatcaactttcgaccaagggtctgcacgaaataatccgtaaagtgctcctagcccgcccccccactgaacatgctctttgaaggattttgttaattccatttttcctttttgatactcataacaatcccacccgtataagtgttgattcacttgtccgactttttcactcaaacttaaacgactaataagatcggaaactcgttgtcgtatcgttaaattcggatcttgatacggatattttttatccaagttgattcactccctctcgtctcgctttgttcgctgctaggacaaatggaacaaataaaaagacatctagtacgattaaaataactgtaagaatcgctgctttaatatcaccgccggtagcaataaatgattgaatcactggtggcgtaatccacggtgcggctgctactgttttttcaatgagtcctatacttgttgcaaaataagcaataattagattgaccgatggaatcaaagcacatggaatcatataaattggattcattacaacaggcaatccaaacataataggttctgtgatattgaataagcaagtcgttaaaccgaattttgcaatttgtcgttgttcttgtcttttagagacccaaagaatagcgattaccaatggcaaaatacatccacccccaccaatcagcccaaaggcgttggtaaaaggttctgtaataatattcggaatttctttccctgcagaaaacgcatccatattttcctgaatcgactgtaataagggtgcttgcctaataggtgctaggatactagaaccgtgcattccaaatacccaaaggaaatcagagaaaaactgtaagaataagatgccgggaacagataaaacaaatgctttaagtggtgtttgaatgatcagttcaatcaaacttggaaaatctaggccagccaatcgattcagagcaaatacaaaaatcgcaaaaattaaaatcacaacagtttccggaatcaacgaattaaatgaggttgctactgctggtggcaccccatcaggcatttttattttgattcgtttgattttagctaatttcataaataactctgttcccaataaagacgcaagcatcgctgtagctaaaccagatgaagaagttaaactttgcataaatacaccagttgcttcagctgtactgccatctgtcagtgtcaccatgcttttgactggcatcaaaataaataagagcgcaacacttaaaacaccggcatgtactgcactaaaggcaggatcatccatctctccagaacgaatatagtgattcgccaagttccaaccaatattataacaaacaacaactgataaaatactcatcgtcccattatttacaatgacagctaaatcagctaatggacttaaatcaataaattgctgaactgttgcatttgaaaagatcaaggcatttaataagaccataatagaggcagccatcactaaaggcatagtgatgataaaactgtcacggatggctaacaaatggcgttgactattcatttttgaaacaattggtaatagtttttcagataatttgtctacaaaactcataggtacatctccttaagtttaaaattgaaccggttcaattttaaactatagcacgtttctgtagaattgcaatcttttttttggatgcgtattcattttctctttccactaaattccgaaaaaaaaagaaaaagatgaatggtctgcaagatgtctcaagagctagtcagcaccattcatctagattaaaccaaacaatgtcccgcttatccaagtaattgattggctagtaaaaagtctttgacttcggttaaatcagtaaaacgccgaacaccttgaaagagcgcctctttgtcgatgattggttgtttgctcaatgggtatcttccttttcttgtcggtaagtctgtcaaatcatcttcgaccataaacgctgagatgcccgctttttcagcagcagctatcccggcaaacgagtcttctaagactaaggcatcttttgggagaaccttcgcctgacaacaagccgtcaaaaaaatttccggatcgggctttccttgcttgacttgatcgccagctacgatgatatcaaaggtagacggcatcttttctagctcaaaataggtggcgattttttctcgggaagaagaggaggctaatgcgatttggcaggtgtgctgcttcagctcctttagtaaatcgagcaaacctggctttttgtagactcttttttcttcggctaaaatggcttctttgtatcggttcatcgaatcccgccattggtcgacagggacatcgccgtacaactctttcattccttgacgaatctcggcttctcttttcccggtcaaataataatagacatcgtggatcaattcaaaatcgtgttcttcagcagattttagataggcacggtaggcaagtcgtcctgtttcaaacattaagccatccatgtcaaaaattactagttggattgtgttcattcgctttctcctactttattttaaaaaagagccatgcgtctagcattagatcgcaccgctcttcgttttgatactcaggtcgattcaagaattgcttttaaggatgctaaatgtgcatccccttgctcataatctctgaccagctcttctgaaaggatgaaagaacccccaactgcgattacttgcggatgagcaaggtagtcttggcaattgtccttagagattccgccagttggcaaaaatcgaacatcatagaagggaccgcttaacgctttgattgcttgtaacccgccataaatatctgctggaaaaaatttcacagttttgatcccaaacgatacggctttctgaatatcatttggtgtcgctgttcctggaaaaatcggaatctgattctttagacagtgatcgataacttctggaacaatagctggagagacaataaactgggccccctttgctaccgcttgttgggcttcttcaagtgttctcaccgtgccggctcccacgagcaacttccctgagcgtgctaagtgttcgattgcttttaacgccagttcgctgcggaaagtcacttcaatcaaacgaatatcatgtttaatcaataattcttctagtggatctagcaacgacatgtctatggcggtataaagcggtaaaactttcgtagccgctaaatgttcggtcaatgattcgacgtttgccattctattcccccgctttctgatcaatttctgcagacatttgcgatttgacaaccgcttcatgcagtccttgcaagtaactaatccccaaagctcgatcatacagaccatatcctggcattgctacttccccccagatcgttcgcccatgatctggacgaatcactccagtaaatcctacatccaccaaggctttcataatggcatacatatctagtgaaccttctgtagacaagtgtgcagactctttgaatttgcggtctcccataaagagaacgtttcggaaatgtacaaaattaattcggtcgccaacctcatggatgatcgacactagttcatttttcggatcggcgcctaacgaaccagtgcatagcgtcaatccattataaggagagtcaacaatagacaatatttttttcaagtcagacaagtttttggtgattcgcggcaagccgaagatctcccaaggcgggtcatccggatggatggccattttaacattcatttcttcgcaaacaggaataattcgtttcagaaaataagccaagttatcgaaaagaacctcttctgtcactccgtcataagtcttcatcagctgattgaatttctttaaccgttcttcttcccaaccaggcagcttgaatccttttgattggctgtggatcaatgtgtacatttcgctaggttccatcccatcaaccactgcttggtcatacagcaatgagaaactgccatcctcattttcataaaaaaaattggtttttgcccaaccaaaaatcggcttaaaactataacaaatcagatgtatgccacaagcagaaagatttttgatcgtctgaatgtaatgatcgatgtagtgatcccgttcttctgttcctgccttgatcgcgtcatggatcgccacactttcgattcctagtaatgtcagttcttctttttcgattgattgttttaattcctcaatttcggcaatttcccaaatatctcctggcagtttgtttaacaaggtgccgatgaccccattgatgccaggtatttgacggacattttgcaaaggaatcgagtctccttcgccataccatctaaagccccatttcatagtcaacatcctttcttaaaaatcatcatcgtcatcctcatcgccagcagctggcgtctcattcgagatatgccaaaaagcaacactatcttctccttgatcgatcactgcttgtgccgctgatgcaattggtgtttgcagtaattgatgattgattgcttctaacaccatcggcaagttggtaccgccaataacgtaaacttcttcttgcagatctttttctaactgattgatcgtcaaaactgactggttgtaagggctagcgctcagtaagtctactaagatcagcaccccttcttgttgattgacttgatgtaccgcggtactgattttttctcccagtgcttgaacatcatctccttgatacaaattgactgtcgctatattttcgactgctcccatgatgactgttgccgcatctttcagtccatcgcttaatgtgccatgagtagcaagtacgattcccaacattgtcattcctcctttgtctccctgcatggatttccatgcaaaacgtttactgtaacaaggcaatcgtcttgtttacattttccatattgatgtctttttgccttaataattgtttaggcagataatatccctctgttgattccttatttccgctgatcacataattgattgttgcatggattccttcttcttgaaggattccgagtcgtgctaattgtttgcgatcaaactctgttcctactacatgtagaggtgctttggcaccaacagaatccagataataaatcgtagccttgcgtttggctgagtctcgcaaaacttctaatcctcgttcgccatagcttccttcatccaagaacgcaaacgcagtgttttgtcgttcattttcactgattaaagccaataatgccaaaaccgaagaagtatttctcgttaagtttttctggaagaccgccccttttaccacttttcccaataaaagaaagtacgaaccaaatgccagaaccaagaaaaatgtttgccaagaaaaaagtacaaaaccgtcagcagcaaattgactatagaaccatgtcgctactgcgccgatcccaatcgttatgaatgagctgacaagaataaaattcattgtttgacgaccttgcgcctttcgatcaaaaaaatgataagcgccaaaatgttgcggcggtgtatcataatacgtacaaatgattcgatctgcttgagcaatatctccgatgtaaacatttctcgaagctgctttatgtttcaaatcatattcgattacgcgaatatcttttcttatttgtgagatatctgtcactaaagcatttaggaatctttttttgctgcggtcacttaagcgagaacgataaatatagcggtaacgaaacagccaatcattgaaacggtctttctgcatctttttcatctcccattcttcgaaggatccagcacgttttcaacagcctttgagctagcaaccatcaaatgaccgttgcttttttgttattgatggaactagctcagttgctgtatttggcagttataatccgaattgtttcaagacctcttttaaagaggatttaggagcagaaggtgttgcttggaaatagatgttttcgactccatagtgttcattcatttcctttaatcttgcggcatctgctttattcaagtagacggattttgtgactaacagatctttttctggatctttctgtgcgatcccgccaatgttcaactctttcattggcacaccatgggtgaccagatcataaatcacactgatggtttttgcgatcaggatgcagttgtactctttaaacgcatattcatcccaataaaattttgctttttctggtgtcacgacaatcgttttttgtcctgtgcgactgccggcatttttgtatagatctcgcatgaatttatccttagcaaccacttcatcaacgacgaagatagagttgaccccgcttttttgagacaacgtcatcatgacttgcccatgaatcaaccgttcatccacacgtgctaaatttactacacccattgttttccacttccttttctataaaatccctacgccggctagaatgatcaagatcaaagtcagccagagcagtgcttgcgtaacttttaagccttttttcgtatagaaccaataaacacccattacaacagccaatggcaagatacctggaacaatctggtcaagaatatcttgaatgataaattctcgtcctgaaatatcaaatttcagcgaagaagaaacattgacatagtttccagctaagacccccatcataaacaacccgagaacagacaacgtttcgattgctgtctgaacaccggtgctttgcatcaatccggtcgcgtttcgtcccattgcaaaagcttgtcgagcaaaaaatacacctaaaaatgcttggtataaagcgaaacaggcaaatgggaacaatgcacctagcggacttccctgctgggcccatgggacagcgatcgcaataaagatatactgtactgttccagaatcgatcgcatcaccgatccctgctaaagcacccatcaaccctgcttttgtgttgtacatcaaatcatcttgcatcagaacttctttgttttcatgttcttcttctgcccgctgctgttccatagaagacatcaggcctgtgatcacgccgcccccccagctcaattgcgtgttgaaaaagagcagttgccgcttataggcagccttgagggcgtcttcgttcttatataattttcgtaaaatcggcatcattgcgtataaaagtgacggtgccagatagcgttcaaatgaatgagggatctcgttggcaaagtgccagcgaagatatgctttcgtgacatctttttttgtgatctcctctggagcgatctgtgttgctttcactgattctgtcattttttccttcctccttgtttcttagaatccatcatcgtaatcgtcctcatcaaaggatgcattggacgtattcgtttcagcagctggagctaattttcctttttgtgattgtacaaagatcaatgcgatcagaacaccaaagattgcgtaagtaaccatagtgatttccaatgatttcagtacgacactcataaaataggcaaggaaaaagaaaaccatgtaatctttccgaccaatgacataaacagtcgttgcaatcccgatcgctgccaagccaccacctactacctccagaatatggatgacgacagtcccttcaagggcattgatgacatcagcgatcagtggtgcacccagataaagtgcgatgaaaacaagcggtacaaataaaataaatgaggccaacgttggatacaaaatgatcgaacgagtaattgcttttgtattcatgtcttccactgctttatccgtatatttccctaaaaatgtattgataaagaaccggaactgatacaaataactgcctaaaagtcccactgggacagcaactgcgatcgccgcttcgggcttcagattacctaataatgctaccggtacagcaatagccgcagcaatcgatggttcagctggcattgagccgccgggagagaagacccccatataaatcatctgtagtgcagcagtaacgatcatcgcctgcgctacatcccccatcacgatcccaacaaccaacccagtcatcaatggcgagaaacgaagggttagtgttgccccaccaccaagccatctagacatgactgccgcaacccataaagcaatcagtaaactctgtgtaatgcttaaagtttccatttttcctcctcctaaacctgctcgatatagttttctaaatctaaaagtgcttttttcagccgttctttcgttatagaaaccggaatcagatgaactttctcttttgaatcaacaaatgccactaactgatcgatcacttgcgggtcttctggatagatccccatttgatgcagggacattggcaactgcaattctcgataaaacggcaataactgatcaatgaccgtccatctttcttcaatcgctaattgataaaaaatgccgtaagcaactttttcaccatgcaaaaactgatgacttgctggtagatatttgctgattgcgtcatgcatcgcatgggctgccgcattgcgggcgtatttgtcacccaatccaccaactaaaccggcaactgcaaacacaatctctgacaagtgaatgaattcttctgttaccttttgctcttccatatcttggattgcttgttttgactgagatacaatcgctttctcgcatagtttggctgtgtagccagccaattgtagaaaaggctcatgttgaagctgtggttgcgccaaaattgtttctgattcataccactttgctaaggtatctgctagtccagcaataaagtaggaaactggcgcatcaatcactagtgtcggatctgtaatcaaaaaagctgcttgccgcaagaagtgctctgacattccttcagattcgccgttttctttatacatcacagctaacggtgtccatggtgcacaattacttgctaaggttggcacgacaccaaatggcgtattggtcagatgggctgcgtacccgaccaaatcggtcaattttccgccgccgacaccgatgataaagtcaatgtgatgtgcttctacttgatctttgatcaaatttgcaccgtagtaactgcattccccagtatactgatgataaaaaacatcctggggcgcctcgttgataaaagtcaatttgggttgcgctttttgccatgaaatcgagccatgaacgattaataatcgtttggcttgatattcttgcagcagctctggaatatgggctaatgcaccttcatggtaacgataaaactgaggaccaacttttacttttaaatcagttaacatttccttccctccttatgagaaaacaagaaaatcgctttgatcttgaacagctcgttctggtaattgcccttgaatgatctgttcgatgtccgtcacacatttttctcccatctgttcgagacactccattgtgtaagcagacgtatgaggtgtcatgattacgttatcaaatgccaggtatgggtgatccttgcgccccggttcttcttctaaaacatctgtcgctaagccagcgatcttcccggattttaaaccgtttacaattgcttgttcatctaaaagtgctccgcgagcactatttgacaaatatacttggtctttcattttttcaatttctttggttgaaatcatatgataattttcatctgtcaaattggcacacagacaaatgatgtctgaacgagtcagtaactcatctaactcaactttcttcccgccataactttgtatgtggagtgctgattgatagggatcataggctaatacctcacagcgaaacccattgcgcaaaatctccacgacacaacttcctgtgttgcctacacctatgacacctactgttttattgaacaatgctcgcccgacgaatttggctcgtgactcccattgatcttgccgaactttcacagatgactctacggtacaccgcaaaagcgccaacagattcgtcacattattttctgccaccgcatctcgttccaccaatgctgggatgatcgaaacgatcgtttgatggttacgtgcagctgctagatcgatattgttgtagccaataccatgacgagtgatcaataatagctcatctttgtgttcaaaaaattcctctgtaaagtgaggcgtcacactggcgatgatcagattataaccttgtaaacgttgcgccaattccttcccggaaatgtcactttccacatcaaaatgagtcactgtgccgattttttcgagcctctggatatgttgaggaaatattttgccaaaactactagagttgactatcgcaatcttatactcaagcatcctaagtctccttcctttattccgtttttgttacgatttcgtgtccgccaaatccatttctcagcgcagacaccacttttgctgagaagctgtcttgttcttgtgataaatttctcatgaaaagacttaatgcaattgttggaacggcaacgtccatttccagtgctgtttccaccgtccatttggcttctcctgaagcagcaacgataccccgatattcttctaagtgggggctgttggaaaattgtgcttcggcaatctccatcaaccagctgcggattaccgatccgtggttccagacatgggctactgctgctaaatcaaaagcatactcactctgctcaatcagttggaacccttcaccgattgcttgcatcatgccatattcgatcccgttgtggatcatcttcaagaaatgaccgcttcctgatacgcctgcataaagatatccgccctcaatagcaacatttttgaatacttgttcgatcgaatgaaaggcatttaagtcgccgccgaccatcagacaagcattcttgcgcgcaccggagattcctcctgaagtgccgcaatccaaataggcaacctctttgtctgaaaattgtttccctcgtcgaatcgaatctttataatttgaatttccaccttctatcacgatatcttctggtaaaacaagtggcagcaagtcttttagtaccgattctgtgatttcccctgctggcagcatcagccagatgactcgtttgccagtaaatgaagcgaccatttggctgatagtctcatatgtttctattccctcccttcgtgcagcaagtcgtgcttgttctgaaagatccagccctttcgttcgatagccatgatcttttaaattgcttgctaagttcaagcccattttgccaagaccgataataccaatctccatgatagcgcctccatttctatcttcattatacaaaaaaatatttttttgtaaatataaataataaaaaatattttttatttgcatttctttggaaatcgttgtactttaaaaatgaaggcttcggaatgtattgaaaaaggagaaaaacactatgactatatcgattcgcttaaaaatcaagaccctctataaagacttaagccccaaagaacaagcaatcgccgattacatactcgaaaaccccagtaaggttagccatagttccattagtgatttagcaaatgagctaggaatggcggattcgacattttttcaatttacaaaaaaacttggttacaacggttttaaagactttaagatggccatgttgatgcaagaaaatgatttatccgccatctctttccacgaaaatattcagcaatcagataacgagctgaccatggcgcgcaaagtctttgattccaacctcaccacattgaccgatacgcgaaaactactgcaagaagaagatttgaaacaagccgtccaaatgatcgacagtgccaagcgattgttcttttttggcgtaggcggttctgaaatcgttgcagctgatgcataccataaattcttgcgctcaccgatttctgtcgttcacagtgcggattatcacattcagttgatggaagcagcgttactgaccccagaagattgtgccctgttgatttctcatacgggtaaatcgaaagaaacgattgaacttgcgcaagtcgccaaagattgcggcgccaaagttatcgttattaccagtcacgcagcatctccgctagccaaattaggggatgtcgtatttatttctgtttccgaagagatcgaatttcgttcagaagctcttgcttccagaatctctcaactaagtatcatcgattcgctctatgtgattttgatgtttatcaaccgcaacaaatcccaagactccattgcgaaagttcgacgtacgatttctaaaatcaaagaatagccttctttaaatagcgtagcagcctaatctttaaaacctttcaatcatgtactaatgggttatgaaaaagtaatttcctctgctctcctttctttggacttcagaggattgatggctagtctaaataaaaaccaaagctaacgattaaagttctgataccgtctaagcacaagcgtgttcgatttttagtccatgataatagaaaaaagcagactgtctttcctcatagaaaaacagtctgctttctcttgttaaaaatcctcacaagtcgcgatgatcccttaagcgataaccgagaccaatctcagtgatcaagtattcgggactgatggtattggtctcgatcttttttcgtatatttgacatattgacccgcaatacttgcggatcagtgccataaggtccccaaacttctgtcgccaacgtttggtacgttacgactttgcctagatgttggaacaaaacagttaaaattcggtactcatttttggttaaatggatctctgttccggccttagtcaaaagctgcctttcagtatcaagtgttaattcaccattcttgatgactagcggcattggctcttgcttccgatgcctgaatgctgtgcggatccttgcaagcaattcattcataccaaatggcttggtcacataatcatccgcaccaagatccaacgctttgactttctcgctttcattgctgcgagctgaaatcacgatcaatggcaccgccatccgtttgcgaatgattttcaataactccatgccgtcaatatcgggtagtcctaggtcaagtaaaatcaaatcaaaggattgttcctgaaaaatcgtcagaacagccattccagtctctgctactcgaatatgatacctttctttttctaaaacgacttccataaaatcggcgatcgtcggatcgtcttcaatcagcaagacagttcttcccatgatgcccacctccagttaattcaaataaatgcgtacgaccgtttgaccatctgctacggccatctccaacttgccatgatgggcatgaacaatggttttgacgatactcaagccgatgccgagaccattttttgagtctaccggcacttcattgtctgaagacagatttgattggatccgttcaaactgcttcatcgatatttctccggtattttttatttcacataccgttttcgctccttcttgaaagacagacaagtaaacttttcccgaatctgaaccatgacgaaaggcattttctaccaaattaaaaattgcttgttccatcaaaatcggatctacctccacgaacaggaccgattccggcagctgaacgatcaactctttttccggatagacttttttggcatgttcatagactgcaccaatgatttcttcaattggttctgcggttttcttgacttgcatcgtgtccatgttgatgcgagtgatcgaaagcaaattctccaccatgcggatcagccattgagactcactttgaatgtctgtcaataacttgctgcgagtcgcttcctttaaagagttattagtttgtaagagcgtctccgcaattcctgaaatcgccgttaaaggtgtccgtagatcatgagagatggcccgcaacaaattgctgcgaactttttctcgttcattttctaattcaattttttctttttcatccttcaattctgtttgttctaaaatcacagctaactgggtcaacactaagcgcagataatttagttggctgttctcaagtggaaaattacggcttctgcgaatgcctaaaacggccaatgttttgctgttggcaataatcggtaaataaaatccctttgcaccacttaatgtatcggtcccatagccagactctttctgatttttggcagaccaataagcaacagccgcttcttccggatgactcaatgcggattgtttttttgctccatattggctttgtttttgcgcttgtgcatcatacaaaatcacttcgcgatctaacaagcgggccagataggtggctgacaaatcaaaaatctgctgccggtcttctgctagaacaaattgcttgttcagctcataaagtatttccatctgctgttctttttccattgaatgaacagcttgtttttttaaacgaaccattagattactgatcattagtgcgacaagcagcatgatgactaacgtaatcggataaccttgtttatagacggtcaaggagtacagtggttcaacgaagaaccagttgaaggctaggacgctcaggatcgaagaaagagcgctccagaaatagcctgaagttagacgcgccacaagtagaataaaaaaaatgtagacgagcatcaaattctgatcaccaaaatgcaaatactgcatcacttcagtcgtcagtgtcgctaagaaaacactgatcagggcaatcgctagatcctttccccctccttcaatgactttcttggaaagagaaaaaatggaagcacgctcctctttgtaaggaatcaaatgaatctcagtgtcaggcaaccgtttcagtagccgcacatcaagttcttccacaaacagtttctcataccatggcttggccaggtttttacccatgatgatgtcggtggctcccaccagcttggcatattcgatgattgtttcaaaataattgtcttcttcaatgacaacgacttccgcgcctaacttttcggctaatgtcgttgcttcatttttttcttccgaacgtatgtaaagcacagtccattcagcacctaggccttgcgctaatcgcgctgtccaacgaatacttttttctgccattttagggaatgcatcctggacaatcgtgatcagtttgctctggattccattggttcggccactgattcgattgatgtggtcagaagcccgctgaatcgccaatccccgcagttgttccagttttttgggaataaaaaaattctgcaacgctcgcttggcattttcgttggcatagatttttccttgtgccaaccgatcgatcagctcatccggctcgacatcgatcactttcaatgttgcttgttggaagaatgtatctgggaccgtctctttgacttcgatcccagttacttcttctacaatatcattcaagctttcaatgtgttggacattgaccgtcgtatgcacatcaataccggcatttaaaagttcttcaatgtcttgatacctcttgcgatttcttgatccttcagcgttcgtatgggccaactcatcgattaagacaatcgcaggctgctgctgaatgatcgcatcgatatctggttcagtcaacgtgatccctttgtattggatttctttcaacggaatctgcggcaaaccagccagcagactattggtatctggacgatcatggggttcgatgtagcctatcaccacatctttgccgagggcttttagttcctgtgcttctaaaagcatggcgtaagtttttcctactcctgcagcaaagccaaagtacacccgcagccggcctttttttcgattttctgctttcaatgtatctactgatgttggtctatccatgtttgcttctcccatcaacaatcacttacagtttatctaatgctaaattcagttcaagcacattgacaaatgttcgatcagaaaaccaatctttttgtgtcttttcttttattatagcacgaatggctgtttccttctgtttacgttctttggcgatgcgaggtacttgtatctcggctgcagcgacactaatatgcggatctaatccgctggctgatgcagtcaccagatcaaccggtacctctgtgatttgattttctctttgaagcgcggtctttctgtcggataccagtccctcttgttccgcagagaccggagacaattgggagaccgcattgcttctgccagcaaagtagcctggttgcaggaactgctgaccaatcagtgttgaaccaactacttctccctctaccattcgttgactaccattggcttggttggaaaatagcaattgaccgacaccagtgatcacagccgtatacaccccgccaaaaaacaaaatactaaacaccaagaaacgcaattgagtccctagaatctttttcatttctgcatccttctttcaatttgttcatagtaggaaaaagcttagcacgatatcgatcaatttgataaaaatgaaaggtgcgatcaatccgcctagtccatataccagtaaattgtggcgcaaaatttggctggctggtttttctttgtatttgactccttttagagctaatggaatcaaagcaacgataatgaccgcattgtaaatcacggctgacaagatcgccgtcagtggactacctaactgcatcacgttcaattgcgccagttcaggatagatgccataaaaaagaacagggatcacggcgaaatatttcgccacatcattggcaatgctgaatgtcgtcaatgcaccacgagtcatcaacagctgtttaccgattcgtacgacctgtagcaatttggttggactggaatccagatcgatcatgttgccagcctctttggcagcctgtgttccagtattcatagccattgccacatctgcttgagccaatgctggtgcatcgttggttccgtcgccggtcatggcaaccaagtgtcctttttcttggtattgccgaatcaattccattttgttttctggcgttgcttcagcgaggaaatcatcgactcccgcttctgctgcaatcgctgctgcggtcaacgggttgtctcctgtgatcatgatagttttgatacccattttccgcatatcggcaaaattttcctgtacaccgtttttgacgatgtccttcaaatagatgacccccatgacttggtcatttttgacaactaccaacggggtacccccagagtgcgccactttggctacgatttggtcacactgtggtgggtaggtaccgccacgagcgagcacatatttcttgatcgtatccgccgcacctttacgaatttgatcgccacgataatccatgccgctcatccgtgttttggcactaaaatcgataaatttcacttcggattgttcaaaagcgcgttctcgaatcccaaatttttctttggctagaataacaatactgcggccttctgccgtttcgtcagctaatgaggaaagctgcgcggcatctgctaattgttcttcactaataccggctacaggtagaaaggcacttgcccgacgatttcccagtgtaatggttcctgttttatccaataacaaaatatcgacatcaccagccgcttcgatggcacgaccgctcatggcaataacattttctttcgtcagacggctcattccagcaatcccgatcgaagagatcagtgcaccgatggtcgttggggctagacaaacgagcaatgcaataattacaatactagaaagcgcggttcctttttgcgaaagaatactgcttaattccgtaaatgggactaatgttactgccaccgctaaaaagatgatcgtcaatgtgatcagaaaaatctgcagcccaatttcattaggcgtttttttgcgttgtgtcccttctaccattgaaatcattttatccaaaaacgaatgtccattttcagacgtcactcgaatgaccaagtaatcggaaaccactgttgtcccgccagtgactgcactgcggtctccacctgattctcgaattactggcgctgattcacccgtaatggcactttcatctaccgaggcagcaccttcaatgacatcgccgtctgccggaatctgttgtccagaaacgacataaaccaagtcaccttttttcaaatctgatgacttcatttcgatgaactgctctaattggatatcctgtaaatcattgattttgtaagtcatgacatcttttttggcttgttttaagctatctgcctgagctttcccacgaccttccgcgaccgcttcagcaaaatttgcgaacagtaatgtgagccaaagtaagctggtgatcgtgatggtaaaccacaatggaatgtcagattgttcaaagcagagaaccgtcgctgcgatggcaccaatataaaccacgaacatcactggattttttatttgttgccgcggatctagtttgagaaatgcttgcttgattgcccagcgatatatctttttcattttattcttctcctttttatttcagtgtaagaaaatctgcgatcggacctaatgccaatgcaggtagaaaacttaatgccccgatcactaaaatcacaatcatcaacatcgtgacgaatgtcggattgacggtagaaagagtaccgtcattcacagctactttcttcttgcgtcccatgttttcagccaaaaataaaacggcgatgatcggaatataccgagagaaaagcatgagtccactacctaagacattcaaaaatggggtatctgctaacaacccattaaatgcacttccgttgttattagccaatgatgttgctccgtataacagctcactaaatccgtgagcccctttgttggtcaaccattccaaaatatccgggtgcatcgcaagcgccatcgccccaaacagcgtcagcagaagcggcgtcaaaatgactaaacttgccattttgatatcaaaggcttcgattttcttgcctaaatattctggtgtgcgtccaacaagcagtccggcaatgaacactgctaaaagcagaaatgctaacatcccataaagcccgctaccgacaccaccaaaaatgatttcccctagttgcatgagaaacatcggcactgcaccgcctaatggagtgaagctatccaacatcgcgttgaccgatccattggaagctgccgtggtactgactgcccacaaacttgaccagccaatcccaaagcgaatttctttgccttccatattggctgaaccaacgacatcgttgaaaatcggtccatagttttcactgatcaatacacctaaaaaagcggcaaataggaagaacagcgaaacaaataaaatcgttcgtccttgtttccagtcttttacccaaaagccaaaagcaaaaatcagcgcagctggtaaaaggagaatggctaaattctcgataaagtttgaaaaaatcgtcggattctcaaatggataggccgaattggccccaaaaaagccgccaccgttcgtccctaactgtttgatagccacctgactagcaacagggccaagatataaccaaagattttctccttccaaactgttgtaggccattccgctactgaaggtttgaacgactccttgagagatcaataaaatcgcaatgatcgtggacagtggtaataggatatacaataatccgcgaaccatgtcttgccaaaaattgcctaaataggattcttttttctgaaccaatccacgaatgaatgcacaaagaacagccaatccaactgccgccgacaagaaattttggacagtcaaaccaaagacttgtgtactattggatagtgccaactcgccagaatatgcttgccagttcgtattagtgataaagctgacagctgtattaagtgctaaatcaaaagacagattatcaacctttgctccacccggcagccaaccttgaaccattaaaagtaccgtcaaaaacagcagcgaactgattcctagccctaatacactgatcaaataacgttttgcggacatttttcgctgactttctgaaccgatcaaccgatagaaaccgcgctcgatcggttggataaagcggacgaaacggggcgtctcccccgtcatgatcatcttgatataaaaccctaaaggggctgctaaaatcagtaatacaaaaaagaaaaacagcccttgaaaaacaaagctcatcataactcttcccccttgaacagaaaccaaaatagataaagcatcaatccaaaactcaaacatcctaaaagtagtaacatcttcttcctctcctttgatcttatcttaaaaaaaatgttgtaaagatagtatcaaggttcgctggatttctttatatcttctttatacgatgagctgtaacacaatctgtctgtttacagcgaattagcggatttatcttcttgcccaccctgttatatttggttatacttgtctcacttaatctagagaggagcaatcaataatgcagtttacgatctcgggtctggtcttaatcccgttatttcttgttacttgctatttgattctgcgttacaatgctgctcagctttcactttttcaaaaaataacggttggagctttgttttctatagtttcgctgtcctttacttgacttttttcccttttcaaatccaaacaggggtctatgccaatcaatccgattggcttagtcgcatcaacttctccttagcagcagatctttcgatactccctaatctcattatgttggcgccattagctgttttttattatttgatggctaacaaaacttctatttttcgagctgttctgctgggattttcggtcagctttagtatcgaagtactgcagtttttaagcaattatttcctaggcggctggcgaggggcagatgtcgtggatttgattgcaaataccgttggggcattacttggttatttactcagtcgctttcttttcactgtgctgcctgagcgatcctttcttagaaaatttatgcttcattcccctagtgagtcgtaaatcaactatcggagcaagcaaaaaagagcccgtcaaaaggctctttttcgtatctgtctattcgaaaagaaaatcttgcagttttactagatgggtattgctgttgccggaaatcaagcagatcactttgtttagcgatttgttgaaacgatcgtggcaccaaaaggcatcaatgctagacccgctagtttcagcgactgtttcgcaaaaggaatcccaataatcgtaatcgttaagagaatggcactcatcagatgagcgattgccaaaggtattcctgaaaaaatcagccacaggatattcaatagcaaagaaacccctgaaccactatagacaacttcttttccaaaaggagccaatgataaagaagcgaatttaaaacactgcaaaccaatcgggataccgatgatcgtcacacaccacagacaaccggccaaaaaccacgaaattgcaccaagcaatccaccaaaaatcatccaaatcaggtttcctaaacaactcatactcatcacattcctttcctttgaaaaaagcggccatcatagatgacgaccgccttgcattatccttcgttcgtttttgattacattcatttagccaactgcttattcgttagaatttccgccaaatacacccgtgatcgaagaccaaagtccactgaagaagtttttaacattttcccatagtcctttggatttttcttcaatttgtttgcgggcttctgaaagatccaactctttgacaaaatcttcaaaaatatttttgtctttcatgtcgctcatcaatgttgtcaattcagtaacttgatccgaagtcacgattccctctaaaccattgtctttcaatgctttttcaacagttgcttgaatatcggattgggtcaattctgagccatcagctgtttgggcagctagctctgttttcgcttgttcttgtgcagcattcagagcttcatcagaatagccttctttgtctttgttttcttctgtaatggttgataagacatccatttcatcttgcgcaacactgacacgatcttgattgatgatgccgccggattcttcaacgattttgtagactcctgccaatgccccagaaccgtcaatcggtacagcagaagctactgttagcttagcatctgtgatcccagcagtcagtgcggcattttggtattgtgcggcagtgatgcgggtgatatttttaggtgtcgcaatatccaccgtgattccttcgccactatcaagggtctgcatgcggacagaactatacaccgcccaatctttagtaaagccaccatcagggatatatttcattaaatcggaacctgaagtcgtatagatcggtgtttctcctttgatccccagttgatccagggtatagttttcttgctcttttgttaatgcattaccaatggctaccgcattgatctgcaatttttctttactatccgtcgtagaagtcgcagtttctgagcttgctgtctctgaagctgccgaagacgaggtttcgatcgtttgtgagattgctgagcgcccttcacttgaagttgattcttcagcaaatgctaatggtgcggcaactaaaacttggctagaaaccaagagagtggctaaaatcatttgtttttttctgatattttttttcatagtatcctccatctaactattttcctgtttctattattgtactataagagatacgtttcgacctacggctagggtcggatttgaaggaaaatttatgatctacttgtttaatgaatcgaaaggaatgtttttttatcagaaaaaatagccggttgaaagggaatcgtactatccattgaacaatacagcagggtctaaattctagtctacgttataaaaattattttcttgttcacttcaacttttttctttaattcatatttacattcaatattcagaaaatactggcattataggtaaaaagaactagatagattattattcgaactaaaccttacaaagtggcaaaatttattttactacagataagcaactgaaaagagaataaatctagaaccttaatattcaaaaagactttgacataggtctgatactactttatttcatattaatcgtaaatcgtaccgtcttatttatccgtatatatctttttttgtaaattcactctgctcttacttaaatagattgtaaattaatccaaaacgaatacgagagtggagcaataatcagattttcttttgactattgctccactctggtattttttattactaattaatatttctctgaaatatgttactcaaaaaactagtaatctaaggccttataatatcgacggatatctaaaggatgcttgcgaacattttctaaatgcacacttagtctcataaatgctgatctcattacaattggcgatagtatccatctaaacttgtcacttattcctacaagttcaaagtcttttgtgtcaaaaactgtcactttattacttactcgatgaacaaaattttctacacgatccatttgaccacgtgttttatcttctcctttaagtaaaacaacagggatttctctatctattacttccaatgtgccgtggaaaaaatctgccgcagagattggtcttgttggcatccattgcatttcttccattatgcacataccatagcatactgcccaagactctaaatttcctgagccaattagataagtgagtggttcgttccaatacttttctgcgtaattttccattgatttatctgcttttttatacacattgacaatattggaaggcatagattttaattcatccataaacttctcatactcttcaaattgtccagctttgttcataaatcttaatagtacactataccaccagtagtattcagctccaaaagtattcgctaaataatctactttttctgctaaaggtgtatttaactgctctacatatcctatgactctagctccaacttcatgagcgatatcaattgctttttccacttccactgtatgccctgacaatgaagctattacaacaaccgaatctttcgtaaaattagcatttccttcataaacaaagtcttgtgcgttttccagatatattggcagctggcatcccaattgttttactgtatgaactacttgatctgcatacaaataagttccaccaattcctagcaggaaaatattcttatatccattatcaacgatttcatcaacaatcttttcaactttctttacaagatcaaccccattttgatgttcttggtaaattctttcttcattaaaatttaacattgtcttactctccttagtttaaaattccaaattgggcacaaatgatcccaaaaatagctgttcctataatcatccataaaacgtttacttttttcttcaacaaataatagtaaaatccagtaattcctaaacttagcattcctggtaaaattccatcaagaatttcttgaaatctagtggccgactcaccctctccaatagtcaatggggtttgcacaacaactaattcatttgtcatacctccaatcaccataactcctaaaattgctgctgcgagcatgaacttactcattaagccagttttctgaattttttctaaataattagctccgagttcataacctttgaatgagcagaaatagcgcaaaataaaagctggtacattaaatatgattaaaaacaaaattgggcctaggatatttccttgagcagctaaagaagctccaatgccgactgctagtatacgaagggttcctaacataatcgaatctccaataccacttagaggtcccattagagctgctttaacagcattaatcgatgatgtatcaaaatcaggatttgtagcattcatttcttccatagctaatgttactccgcctacaaaaggtgagatatgcgaggtgatattgaaaaactctagatgcctttttaatgcttgagctaaaccatctttatcatccttgtagatttttcttaaacctgaactgatcatggaacaaaaacccatatgcatttgtcgctcataatgccaagaaaattccattgataaagaacgccaaaacatttttctaaggtcttttttagtaattactctatttgtttcattagaagtcatcatcaatatcctcacttccttcagcaaaagctacatctgaatttttgcttgttgtaaaattgattttcacaaaaattgtaattaaccctataatagctatacccactactggaatctggaaataagcggataacacaaatcctagaaaaaagaacggaactacttctttattcataaccattctagctaacatagcaaaaccaatagctggaagtataccggtggcaatagatagaccatctgtaattactgaaggtatagcattcactacagcccccatttttgaactacctaaagaaaaacctaaaaaggtaataataaacaaaactgtacaagtaataaatccagtaatcatatgaatcgcagtcacttttgaagcctcacctttttctgcatagttatctgcaactttggccataaaaggacgaactaaagtaaaaataaagttatcaactacttgtgccaatagtgctattggaaatgccatagtaaaagcaatatctgcacctttaccaactgttatcgcaaaagctgtacctaatacaccacctacaattacattcggcggaatataagcacctacagagacctgccccaaaaatgctaactcaagtgtagctccaattgttattcctagttgtaaatctcctaaaactagcccaactaatggtcctaatacaatggggcgttgaatcatgtttgtccctgttgctaaatcacacttccctataaaagcaatacaccccaataaaaaagcttgtagcataagtttattctcctttctaatttatatttttcaaaattgatactgcccttatcgctttttcgcctggaaccatccgaatctctacattcactcctaatttgtctaattcttttattatttctatttctgccattgttatatttacagacttagaaatattttgtgttccatttgttgccttggttccacctagattaatttcttttatatttggacaatttttggctaagttaaatgcgtctttaattgattccacaacaataaagagcttatatttatctgttacaccactgttgatagcgttaatagaatcctcaatattcttaataactaattttactccttgaggtttcgctaactttatggtggtttttctgaggtcatttgtcggcacatcatcattggcgatcaagatacaatctgcccctaagctttgcgtccaagaaaatgcaacttgtccatgtaagagtcggtgatcgactcgtgtcaaaataatcatgtcgttcctcctaaaattcttcttcttcgatttcttttgctacactctcattgcagaactggatcatatctttcgaattagccaacgtttggtggatcgtttctgagatggcacctcctccttgaagttgtgttgtcaattcaatcaacaatggcaaattcaatcctgcgatcaagtagaaattcggttgttggatataacgtaaaaattcattgttcacactgccaccgaaaatatctgtgataacgatcatttcgtgctgtttataggtttccatcagtgtatctatagttgctgttagatcgaatgcttcttgaacataacaatcaatggcaatgactgattgtttttttccacaaataagttctaaagaatgcaagattcctgatgcaaatttaccgtgtgatgctaaaataatgatttgctccactgctttcacctctctttgcgccaagttacactttattaaacgcaaaaagcgtgccaaaaaaagtggcacgctttccttatcgattaaaaatccgcttcaaccattgaagaatcagtgtttccaaataaaacatcatagatatagcaaacttcagattctggtatcgcgacactgtaaaccttttcaatgacactaaacgcctttttgatctctttcagctgtttttcatgacactgaagcagtgtgtcgctggcatgataattctcaatggcttcatttcgaatcagtcgttcgatcaaacaacttgtatggacaaacaacgcaagcttgcggtcattagtgattctttgctgccatatacgttccagattccccacaaagaattccatttgagaaatcactttctctgtatctagaatcgtcacagattgaatcactcgatccagcgaaaagtttcttactaattgattgttcacatacgcaatcatctcttcatccaattcttctttcagccaacttaatagcactgctgtacctgcgccagaaatcagttcttctaaagaaataaaaggagccagctcttgacgaggtttgttggttcctacaacaccaacaatgtcatacgatgtcaaagcctgtttgacatgttccctattttccaactgattgaactcataagggagaattcgaatctgtaaatgatctggaatgctcttttctaataaatttgagatttgaaccgcagttccaatccctgttgaacacgttgtgatgacaactttctcttttttcgtttgcggaagaataatctcccattcattttgactgtaggcatttacccgttctggaatttccctcagcgaaacattttgctggatacattcccccacagcgatggctacacttgtcgttacattgttcatcatgacgattggaaccgtcaattctggaatatactgatagatttctttcaacgaacccatgtcgaacaagaccactagtccattagatacatcatttttttgaatatatgcggtgaccctttctgcaatttgcttgggcgtgacatctaatggcatatcgaaagactgaaaaaccgattcattcaacaaacgattcgctacattcgcaatgctgctggcagttgcgtagccatgagccacgatgatacttctcggaagcaatgaatctttggtataccccatatcgttgatatagagtgtaaagataatgcgatccatactggttaactcgatatccaatgctttttgtactagccctaacagattttcggtgtagcgatcacttgtcgaataatgctttttaacgctcttcagtaggttctctgtcaataaaagtttgtcttgatcatccggcagccactccacatttcgccgcagccataaataataactgatcgtataaaccatgctgccgttaaagctgatttggaaggaatgttcaatctgttccatcattcgctggacatgctcggtcacaaaaatcatcgtccgctgcttttgttcttgcttatgatcaaacaataaattttcgaatagtctttcaatcactttagaaataggatcagctgcagctgtaaaatcctgtcctgcctggacataattgagcaggatctgttcatatgtttgaatgatcttttgttgttctggctcactttcggcagtcagctgctggatttgcgtttgcccatcgataagaatcgattgcgtcgtcgctgactcattgggttcatctgtcaattgcagtaaatgttctggtaaatgatagaccgtgactgctatttttttggctttccgctttagactagcagtatagcttttggcagtaataatcttgatcgtacttttcaattcaccgacattcccagaaaaatgactcgtcgttaacatttcgatcacttgaggtgagagttctaacggcaaaccgatgcgcttttgctcttcaaaaaatgcttgcaagatcagttgcttccgttcagaaatcgttcgttcttccaaagcaggcaatgtcgcttggatcgggattcgccgcaaaaaagttgttagaaaagtttgtttcaaatcttctgtcgttgcaaacaccaaccgacaatccaccgtgactggtcgtcttgtatcccccattcgatagatgacaccttgatccagaaaagtgaataatttttcctgtccttcagcattcaaccgatgaacttcatcgagaaacaagacaccgccatctgctgcttcaaaagcaccagcacgatcttcctctgcgccggtaaaagcccctttgacatgtccaaataaattactagtcaatagctcttggttgttggcgtactgtgcgcaattgatggtgatcaaaggcgcatcgacctccaataattcattggccacacaatagtgatggaacatttttaccagaaaactcttccccgtcccactttcccccgtcagtaagaagggaagcccaccatttggatagaaggcggccatcttgatctgttcaatgacttctgccagactgcctttgctgccgatcacactggaaaagaaatcttctttttgatcaaaaaaaggtttttccgccgcaacagcagccagactctcgtatacgttttgtgttaaggggtagttttggctctcaaatgcctgcttatgaaaaaaataaacgggtcgggtcgcaattttcactaaacgactttcttccgttagctgattcaaatagtgactgatcgtgtttctcttgactgaaaacttctcggcaatatctttcgctgtaaagatatcgcttacattttctgcagagaaaaaagccgtctggttttgcaagtaagcaagtaattgttctttcatcgctgttctccttgtcctctttctccgtttatcatagcttacgattcttaaaaaaccaagaggtgacagaggaagttgcttggaatgaataatttcgaggatatttccctcaactataggtcatcttgaaaagagtccttagcataaaatttatgatccaataaaaatcactcaaggcagtcacattttttttagaccgttcacagatcttgcccttccgctagagactcttttcattttcatagatacctctatttcttgcaatctaaagtaaatcatcaaagctgacggttccgcaacaagtcctccctttttattcctttacaatactctctacttattgcattctattcctttcttaaatcgttacttccgtatgatcccggctcaaggtatataggctggtttcgactttgaagtagtcttcgactaattttttcaactcagccattgcggcatcagcccgtaaatgttgttcttcattgattgattcaatgaacaatactgcgttgacggtctcttcttttaacatcgtgcgttgcgcttctcgccaatttaaacagcggcagatggctccttgctcgtcatagtaaatcaattctcctgctagagctggcgcatccgcctcggcgcctaatgggaaaaatgactccccacccttggctagtccaaggtgtaaatcacctgcgattgcagccaaatcttctccacctaaaggcatcccatacttcatagagacactattgtagagatctactaatggattgattggaaaaaaagttcgatcttgattgacacgcttcaacaatgcttctatggaagaacgggcacctttttttgttttaaatttttggaaagcttcccgccattcttggacaactggattttcactgaaggttgcattcgttaagaatcgcttagcttcgcgcttaccgttttccagcaattccgtaaaataactttcttttgcaggatctattgaattgtcgatccctttcacaacgagacaactaatttgtgcttggggaaagatttcccagaatgcttgatcaattactattttcttcattgctttcacactccaaatgtattaataaaaaagcggcaaaacaatatttgctagttccgccaattgattccaaaagttgatcattatttaaacctgtccttttaaactagggaaggttgatcacatttttgaaaaagaaaacgattttctatcctacagtgccgatttctcttgccctatctaattagtagtctctttttccaccattctttacaatcgcccaatccgattcaatagattctctgatctttgaaagtaaatttgacaccgtttctatttctgatgcggatagttgagtggtagcgattttgttcgagtattcgttttctcttaagataaactgcacaacatgctttcctttttcagttgtgtataaatgtttgatttttttattgaacggatcggattcttttaaaatgaatccattctcttccaactttcggacagctcttgacagcgttgtccgatcgactttaatcacctctgctaatcgttcagggataatcccctcattctcaaaaatacgaaccaaataaatatactgccctttgttcagctttaactctttaaattcaatattggcaatggcatcaagcattcggctaatcgagccaatttctcgtaaaatgtcattcattcttctttctcctcttctatcattatcctacctttttattgttgcaaatgcaatattttttcggaatagaaaagagcgaaaccaatgtttcactcttttaaaaaatatttttatcacttatacattctgttgctagttgatcatatttcgccaaccacatgactaacaacaaagattgtttcatttgctcattgcttggaggaagagagctaaaccattgatcattcactagaacccgtcagaggtatcttctatctaaagactagctgattttttccctcagttcgttttgtctgtttttctgacacgtattctcttttattcaaaaaagaactctttagaattgtttctttttcataatcgaaatactgatcctcacagagagtgccaaaagtagcatagcaattactaatgcaataagaaagagcattcccatgctgacaatgggcaatgtgttcaattgagcaatcagatcaacattaaagaagagctttgccccttttacaattacaacaccagcgactaccagaagtccaacagcaccaataatggcaattctgcccttttcgccgccaaactttagttggaagggaaacataatagattggatgatgatcatgatcggcaggatcattgctgcaatctgccagatctcagtgagagaagtagtatctctaacaactgttgcaatcaatcctaagaaagttgccaaaagccatgaactaaatcccagtaggaatcctagacaatatttttccagcacatagcccactcgagtaataggtaaagtgaataaaaacgcatacccattgtcaaattcatcatagctgatagtgcttaatgtgaataaagaaagcgcaaaggttaagaaacctagtgggaatgatacatcctctgtaaacgagatcattcctattacaatcaaaagaataaccaaaaagaaatttttttgtgtggccatcaatttaaaatcttttaccaacaaacctgtcattattcacgcccccttaccatcatcataatcacttcatcaattgatcctttttcaatgactattttaggaaaattctccatataaaattgtttttgattcgttaaacaactatacccatagctttcttctttgtatcggagaataaattgtttatccagttctttgtattgctccggatcaactttcaatagtgcataatcacttaacaagacatcggtctcttcgtgtaagatcattcgtccatcatggatcatataaagatcatcacaaagtgtttctaaatcactagagatatgggaactgatcaaaatcgcacactcttcatctttttccatgaactctctcaacatcaaaagtaattcatctctggcaatcacatccaagccagctgtcggctcatctaaaagcaacaatttagcgtgatgcgatatagctactaatacttttagttttgctttcatccctgttgaaaaatcgttgagtcttttatccactggtagttggaatcgctgaatttgttcggtaaaaaagtcttcgtcaaattcgctatacattgtccgtaaaatcggaacaatatctttaatccttaaatagccgctgaagccagaatcggataaaacaacacctaacttttccttctcttttggggtgagttctttactatccttgcctaaaagtgtgatcttcccactgtcaaaaggaattaaaccaagagctgctttaaacgtggtacttttacctgctccattttgaccaatcaaccctgcgatagtacctttttgaacttctaatgaacaatcaagagaaaaattatcatactgcttttttagatgctcaattttcaacatgtttcaaccctccaatatcaattcaaacaaactttttatctcttcatcactaatcccgcaacgtcgcccttttagaattgcttgttccaagtcttgttccagctcctttttttgctcttccaataaaagctctgtattggtagcagctacataagttcctttcccgtgaaccgttactgtaaaaccttcagattctaacgtatcataggcttttttgaccgttaaagcactgatctttaattcttttgacagtgtgcggacagatggcaacggatcattctcattcagctccccatttcgaatatgccctttgatttgatcgacaatctgctcataaatcggcaccattaaggaagtattaataatcaatctcacattttcttcccccttctcgttgcaaacagtatataacagtacacaactgttatcaagtgttatatactgtttattaaaaaatttttgagtttttactgaacataaacaaaaaaagctaggcaaaagcctagctgagaacacgatttaatcgtgaaagatagatagttatttcatgcgtatgataattgtcccacctataacactcacaatcattatgccgaggacaagcatccaactcgccttctcatcatttgtctgtggaagttttttatcattcgttttatttgaagcgtttaaggcagcagagtgacttgattctgattgattgttctgagtccctaatatggacgaatcagttgtgtttggttctgtcgtacttggttctgtcgtacttggttctgtcgtacttggctccgttacgcttgctctgtgacacttggctctgtcgtacttgatgtttcttttttagtattggtaataatgatggtaccatcctcattggttaccgcactttcaaagtcatctggaacattgacttcttcgacagtgtaaaagaaatcttccccttggttattgtactttggtaatactacattttggccttcaactgggacttttgtgcgtgttccttgatagccctcgcctttattcgaggttaaactatctgacatttgccaactttcagcactaacggtggttgttcttttgacttggtattcgatctgatcaggaatctcagcatctggaacattgacccacttcttcataattttcaattctacgacaggtgccttgatggatggaataggaaaatcgaaatattcaccatcacttcctgttgttaatgtcgtacgtccattacacaagacccatgtttctccttgaaactcagcggattctgtatttattcgaacctgataagttagggtaagtttttcattttcacctaacgcgatgttgctgatagagatggtttgattagcttcagttacttgaactgctgcaacaatttcaggagcttggatccatgctccttgatcatttttgcgccacccgaccaattgataatggctattatcaaacgtaccggctccttgtaaaaggattccttcccccatagggtctgtgatcgttccattgggaatcgttttatcaatgtggttcgcaatttctttcaatgctgaaccaagaccgctaaggttttcgtccgtcgtcaaataattagccggtgcagtagcaagattacgggcaatgtattcaccccttgccgaaggtgccgttgccactgaataaaccgtaaagttcgattccttgatgtcaacgatcgttcctaatgtttcatcagtcaccacttgactgctgactggaactgctaaactatctgttgaagtcttacttgttgtatggtattgaggattagctgtttggaaagctttggtatagctgctagtatgataaccattataatcattgatctttcctgtattgggatacacagttgcattttcagcaggtaaatagctgcgattggcactatcatcgccaatatggataaacttcttttcagcttcaggtcgactttgttcaagaagcagacgttgtccctccatcaagcctttttgcataaatgttcctgagtgtgattccgccgtatgctgtaaaaaattttgcagataatcgatattggttaccttggacgtatcaaaattttctatggccaattctttaagtgaactcgtgccattaaacatggctgtcatgtcaattaccgaggatgtatcccattgattcaagtcaagactttccaaggagcttgcattcccaaacatccagttcatatgagtaactgaagacgtatcaaatttattcgcaccttcgattgcccttaaatttgatgcccccataaataattgtcctgaatttgctggtaggacaaccgtttctttaacaacaataaattcagtagccattgatggaagtttccaaggtgctgcatccacaagcccagcaacccctccataaagcgtaattgtttttgaaacttcatcatagtcccatggaacagttccccagagagaaagctgacgctgataaacgaacacaactgtctgtcccgtatccgagaacgttcctgatacattatcgggtaccgtaattaattcccagccttcgattgttttagcttctgcggtataagtgtctccgtaataaccagtcaatgtcgcactctccgcaacgtcatttccagattcatcaacatatttcacaagaacttctccggctggaattcgcttataagtaaaaacgacggtctggtcaactccagtaaacgtaccagccgcattttgaggagttgtcattagttcccagcccgatatattcttggcttctgcggtataagattctccttgatagccattcagaagcacggtattcgcaatctcatttccagattcatcgacatgcctaactgtcactattcctccaggaatccgttcatatattgcttgaatgactgcttcaccagctccttgtaccgtgatcaaggaagattctgcataaacatcattgacagaaaccccaatgctgctactaatctcccacttgacaaaccgccaattaacattgggtcttgccattatacctgggatcgatcccgtaggtgttggactcacaaattgttgaggatttcctccttctggcggattagcaattaactggactaagggattatttcgctctagaggatgattcattacttgttctgattcttgcctatttgattcgacggtattattggattgagagatctcctctgcataaaccatatctatgggaatatgcgataaaagaatggagaagacaactagaaatttaatcagttgatccattttttttactttttccatcattccctccttttgtataaactagcgaatttaaccatgcgtttcctactctacataagcaataactgcgtttttaaactcgtttaacattcgaccgtttgttattgtctattttttagacacattcctccttccaccttttaaaatcaaaaatcttcgtttttaataagcaaataaaaaaacagacaaatgactttgtataaagacaaaaatcctttgtctctagacagcgcagatgaagtgtgtcccccataagtaagcgtctcaaaaacgaaggcttttgagacaaaagattgagaaatttaaatttctcgagattaatcataacaactcaaaaaaaataaaacccaccaatattttctttacctagtgaaaaaattgacgtgatgttccccttcttcagcagaaaacattttcttcctcaggggattacataacaaacgaaccgatatatttaaaaacagcaatgtgacagggattgtttttttagaatgttttatttccgtaaatagcaaaaaaaacttaacgaccgccatttttttcttgtccttactcaacgccctgctctcttctagacaaacaaattcagcaattattgttttggtttatctgctatcttcaaagaaaaaaactgagtggggaaaaataggatgtttgaaaacgaattttcatttagtcagacaaaataattcgttattttacgttatatacttcatgtacaaaaaaaggtattctttcactaagaaaaattttcaactggaggaatatagatgtcaggaatggtttatggttatgcgcgagtctctacaagacagcaagatctttcacgtcaattggatttacttgagaaatataactgccataatatttatacagaaaagattagtggtacgcaggccaatcggccagagttgatcaaattaaaaaagcgcgtgaagcaacaggatcaaatcatcatcgaaagcttttcccgtcttggccgcagtaccaaagacttaattgatttggtatatttttttgaacaaaaaggtgtgaaagtaatcagtgtcaaagaaaattttgatactcagacaccgcacgggaaattgatgatgaccgttttccaagcatttagtcagtttgaacgtgatattattgtcgaacgtaccaaagaagggctgatttctgcacgggcaagaggaaacattggtggtagacccaaggtagatcctcagttaatccaaaaagctctccttttgtatcaagagtagggctattcagtagcagaagtttgtcaaaagaccggtgtcaagaaagcaacgttttatcgttatttaaaacaatcagcattgcaaggctgatcacttggctttccttcgctaacccagcaaaccacatcaaaaaacgaccattgttttacgatgaaagcaagctcatcacgagtaatccaatggtcttttttctaattttaacacagcaaattttctagtgtttaatcaaatattctctggttcttcttgtttctgatgatattttttttcgaaatcagtccatgatcggctaaattgatgattcgaaaaggcactctttaagccggagctttgtttgaaacgaaagacttcttctgcctccattcccaattctttggcaatccgatcatctgtccatccgcttgctactaattgttgaacgattttgctcatcttctcgataccatgagtgcctcgagctcgattatgtctaacagtggaagccatacggtgttccaatggcttatcgataacagtcactggcacttcttttaggttcaaccgttctttggccacttgatagcggtgaaagccgtcaatcagtaagtacccttctttttcgttgtcaaaataacagactaatggttgtgtgaatccgtcttcccgaatcgacaactccaaaagttccaactcgggttccgctactttattgggattgtagtgattggcgtgaatttgaatcaatggaaccatttttacagctagcacaggaaaagcaattttttccattaaacagaacactcccttttgagaaaataatagttcttcgtttggcgaaaaacggtgaacccttttgtctggaacaacgccacttcgttagggtgactcgttgtgactgtgatttcttgatccggatgtttttttcggatgtcatgcagcatttttcttaacaaaagagtttttctgcctgaagcaggctctttttcatagaattcgccaatctcgatgcgagctgtttttttttcatagtaagagaagcccatcacctgattcagcgaatccacgatcacataccaatggcaatccccagaattaacgagatagggaaattgcttttggtagattcgctcagcaaagaaaggccccatcaattgatagaaatgtcctttcttatatggtggaaaaaagacgatcagttgttctttcaactactccacatcctttcagcaaataactgattacggctgattcttggtcaattgttcataggtctttcctaacttcttcaattggtattttggcaggtgttcgatgcctaatgccgcaccaaattccacggctaacgcatagagttcagactcgtctttcttggtcaatgcgtattgtctggtactcaaagaaaaatcatttttttccaatgctttcgcgatccccttccagtcatgccaaagtacttcattcttcagccattctttgcgtttggtttcatcggggatcgcctctacatgaacaccgtacttgtcccgatagtgagcgatcagaatcgatattttacggtagtaatggtcttgcagatttttggaatataacccaatcgattccagcaaaaagacagcgtactcctgccaagtcatgtgggcaggtttttgggtattgtaatgagccaacaaagaagtccgtgcatacaagcggccaaaattcgcgccagaaacacggttgacgactttctcccaagtatccggttcgactaacgcatattgagaaagtccttttcgttgctgcaggccatatggctgacaaatccgcatttgggagagggacactccataagtgtaaagcttgtcataaaaaccattcatttcccaatcaaagtgcgcatacgccccccagacgtcctctgtcttccagtcataaagcggataaaagttgagaatctccccttgattggtttgatgcttgatccagcaatgtccttgataattgaaattccgatttaaaatagcccggtagcgatgcaagctttcttgggtacgaatgccgatgccgtaggcaaccggctcgcctttatgatgattcgcataccaaaaggcaaaatttttcagaaatttatctgggtttaaattcgcactttggtacagttccatcattgattcatcgagatctgacagcgaaatcgcatccctgggcatttcttggacccacttatcccgttcgacttcatcccacattttccactgaggttgaaaaatactagtcgtgttatcttcataaaatggcaagcagaaatgatagacctgttgaacgcttttcagccgtttgatcgattccataaagttccgagttgaacgataattggcttcgatgtctaaaatcaacaagtcaaattttttccacttttttgggcaatttggtcagctaattggaccattgctccgctgtctttcccaccgctaaaagagaaataaacatgagaaaaggtattgaatatatacgtcagacgttcctcagcagctgccaacacattgatatcgtaatatttcttcataaaccccgcttcttttacttatttttgattgaatttgtgcatgtattcactttcattataaagtgaattggggttgcttacaagcctacctcttaattgcagaatccttcttaacgaaataaacatccaaatatttccactctttctttcgattaggaaaaaaatttgtctgtctaaccctgacattgcttgagctggatcatcaattaagcggattgggaaaatccaatggttatcaaaacgtaaaaatcccactggactagttgctagtctagtgggattttccttactccaatggaaaatcatcgttcgtttttattgtttcgtcactttctccagttgagtggttttttttccacaagatgtacacaacgatgacagcaaccattaagataccgcaattcaaccatttggcatcatttaatacgtgtaaatctggagatgacaatggatcgtttcccgatagctgtaacaagatattcatcgggcgatcaaagagagttgtcataatcagtagaaaagccatcatgacgaattgatgcgtgacactccccttattttgagtggtaaatttggcgatcattcgctgatcaacaggcaaagaaggttcctgcgcataccgttgattcaaccagctgctggtcaaagattgccaaaagcttaataaaaacaaaccaagaacaaaactttgtggaaaaagaagcacaaacaatgaaagagccaaaccaccaagcagaactggaactgtatttggaaaaatcccttgcagaatacgtttgcctaagatcatggacaaaatcattcctccaagataaggcaaatacaaatagcgagtcaacgcctctgtcccatgtagacttcctagataaagcgctccaaataagaaaacaaaattccctaacatgccatttaaaaaagttagcacgttgagccatgagggcagcttccaatgcttcttcgctcgtcccagataaaatacggcacctaagaagaggaaaaagaaaccataaatcgcccaatcaagcaattggatatttgccaataaacgtgcattccgcagcaaaaagagtaacaagaaaaagattagaaaaagaagcaattctttaaaggcgatcacttttgaattcatttgcttaaagtcgatgctatatctaggatagtgggtaactgtatggtaagccatgacgtaaaacatcgtatacaagccaaatgcggctatcagcttcgttgtgcctgaccattccatcaccactaacaacaaaatcagtaagaacaatgcaaaaggcacttttttacgagtcatattgataaatcccaagttcttttcatgaagattgaccgtgcgattcgttggaactagccaagaggcactcagccctagcagactaccggataaatagaaaaatggaaaataataaacacctagaactccagcaaaggctccaacaccacccatcagcaaagcatcaatcagcagtgtataactgtctaatcccaaacgtatactgcggatgagaaaaattcctgtcatccgtaatgtataaaataaagtaaacggcaaaatcgttaaccaactcttgccatcattcaatcctaggaataacaaatacggaatcacgattaccgtattacttaaaagaaatggggtcgtttgtgcaaacgtcacgagccatttcttgattcgttgaaccatcaggaacctccttatttctctctaccaatcactcatctgtggtacgatctattgacatgtacaagtgatcgtttctcatttattataccttttctatataaagaccgcacggctttccataaaaaaagaagctaagagtcgaaggcgttattcctttatcgctcgtttagaatgtcgtttttatcacttacatcttttcttccattgaattcaatcattcgctatgctacactagcgttacttttgtttggctgacgaaccgctgccccaaccatgttcgtttggaccaactcgttgcgagtattcgtgttttcggatgctctttttgtcgcgttttttgccaaaaaagaaagtgagtgaatccaaatgatccaagtgcaacacctcaacaaaagcttcaaagtcgcgaaacgccaaagtggttttcgtaatgctaccaaagcgctctttcatcgagaggtttcaacgatccccgctttacaagatatcagctttacgattcaagaaggagaaatggtcggatacatcggtccgaacggtgccgggaaaagtaccaccatcaaaatcatgtgcggcgttttgacacctgatgacggaacgtgcttgatcaacgggcgcgttccatggaaagaacggatcgatcatgtccgagacattggcgttgtctttggtcaacgcagtcagctctggtgggatgtcccagtcatcgacagtttcgagctgattcgtgatatttatcgggtcgatccgcaagtctatcggcaaaatctggaagagctagtcactttgctcgatctaagcgaaacgttgaaaacccccgcccgttccttgagtctagggcaacgtatgcgctgcgagattgccgcttcgttgctccatgatcccaagattttgtttctagatgaaccgacgattggccttgatgcggtgtctaagatcgcagtgcgccaattcatcaaaaagcgtaatcaggaaaagggaacgactgtcatcctaacgacccatgacatgcaggacattgaagcattgacagaacgcattttactgattggtaaagggcaaattttattagatggtcaattgccagagttgaagcaacgcttctctgacgccaaaacattgcagatcgattatctaggaatcgcaccgacacttccagcaggcgtcactgtaacccaagcagaaatcgggcgattggaactaacgattgatccaaatcagctgaccgttccgcaagctatcacacagcttagccagcaagtggagatcactgatctgtctgtttccagtatcacagcagaagaaatggttgctaagttgtataaggagtaccatatatgaacaagtatcaggcactttttcgcatccgttttacaaatagtctgcaatatcgatcggcagcattcgctggaatggtgacacaattcgtttggggcatgttggagattttcgctttccgcgccttttatcagaccgatccagctgcttttccaatgacctttcagcaaaccgtctcttatgtctggatgcagcaagctttcttagcattgttcatgttatggttttttgaaaatgagatttttgatgccataacatcaggaacgatcgcttacgagttggctcgtccaatggatctctatgaccgctggttttgccaatcagcagcgaaccgctgtgcaaaagctttgctgcgctgcctgccgatttttgctatcgtctttttgttgccagtgccctatcgtttggtcttacccgaaaatctaatggtcttactgttgtttatgctctcgcttcttttaagtctgggtgtggtggtggctgtgtcgatgttgatttatatctcgactttctataccctttcttctctcggggtgcgggtcgtgatgggggcaatcggtgaatttctcgctggcgccattattccgttgccatttttcccacagccttttcgacaaatcgctgaattgctgccttttgccgcgatgcaaaatgtcccgttacggatttatagcggggatttggttggacatgcgttgtggcagatgctgggaatgcagctcttttggttggtggtattggtagctggtggcaagttttggatggctcgtgcgttaaaacgagtgattgtacaggggggttgaagatgtctctttactggaaatattttagtatccatttgaaaagtcaaatgcaatataaggtttcgttcttcttgacggcattaggccaattccttggttcctttaccgcttttctgggaattttgtttatgttttcccagttccatcaagtggatggcttctcatttgaggaagtgctgctgtgctttgcgacagtccttttttctttttcattagcggaatgttttgcccgcggtttcgacctattcccgcaaatgatcgccaatggcgaatttgatcgagcattagtccggcctcgtccgctagtctttcaagtgctggctgctaaaatggaattcactcgcattggtcggctcctgcaagcattgctcttgttttgctatgtactgccaacaagcggcattgattggcagccaatcaaagtgctgactctgactttgatgattctctgtggtgccgtcttgttcttttttctctttttgatttatgccgccatttcttttttcacccttcagggattggaattcatgaacattttcacggacggcgcccgcgaatttggccgttatccatttagcatctacggcaaacaagtcttgcggatcttgacctatgtcattccaatggcttggtttcaatactatccctttttatttatcattggttggctggagcagccactgtgggcgttcgctccattactatgcttgccatttggtattcccgccctcttgttttggcgctttggtctgagcaagtatgtttctaccggttcgtaatgaaaaaggaagtcctcagtcggggcttccttttttcgtaagtctgcggatatttcttttaaaacgataggacaaaaaagccgagcgagtgtacaagtcgatcccaattgccagccaaacaccagcgatccctaaattcaagctattgcctaacactatcacacctactattcgtatcacccacatcccaaacgctgtactatacaatggtgtcttggtgtctcccattccttgcagcacgccagctagaatgagactgatcgctaatcctggttgattgaacgcatcgatcctcaaagccaccacgatttgacgaagtgcttcgggatctttcgtgaacaaagtagcaacaatcggagacccaataaatagtccaatccctaagagactaagaataatcacaccatattttacagataaaaaagcaattcgttttgtctcatcataatctttctttcctatactcattcccgtcagtgtagcagcagccgtcgccaacccataggcaggcatatacacaaagctttcaatactgccagcaatggtgtgtgctgaataggttttggcaccaatcgccacgatcagaccaaagtacaatacctgtcccaaacgcatcactaaccgctccaacgctgctggaaaagaaattcgcaacagttcattgaaactacttttattcaatcgagtaaacaatggaaaagcaataacagaatgctgtacttttcgataaagtaatatcgtacctaacgacctggcaattaatgttcctaacgctgttcccatcacacctaaagctggaattggccctacaccaaaaatcaagacataatccactacgacattcaatacgttcgtaataataccgattttcattggtgttttggtatctccgattgctcgtagcatacttcctaaagtagacatcgttgcaataacaatagctccgccccctacaatactaaaaaattgcagggaagaatcaagggtttcttttgtcgctcccatgatcgttaaaagctgagatccagctactaaacttacaattccaagaaaaagaccagagatgattgccaacaacaacgattgcttagcgatctgctttgctttttctaggttatttgcgccgatacttcgtgaaatcaatgaagatgtcccaattcctaaagcaatgaaaatagctatatatacattcaatattgcattagccaaaccaacacctgcaacagcaaataatccgattttagaaaccatcaatgagtcaataaagcccactgtcgtttccaagacattctccacagttgctggcaatgccaaatgaatgattcgtttctggatttgcatgtcttttggcaaatctgcatttaatttagtcatattctgtcactcaattcaacttgttgtattgggtgatcacccgtttcaaggccttcatttcttcctccaaatccgatccttcactaacatgcatcaatgcatgatccgcttgggcctccaagaggatttggctgattttttgaatggccgaacgagctgagttcaactggatcatgatatccccataatctttattagcgacgaccatctttttaatcccagagacttgcccttcaattttattcaggcgtttaagtaattcatctgtttgatgttctttggcatgtgacatgtcgactcctcctttaatataggggtaccccccacccctatattaatcaaaaattatttccaagtcaaaaagttttgtttaaatccttctattgctaaagtcatttcaattatctttcctcggaggtgctacaaatccgctcatgaatgagagaaacagacagcaacaaactcacttagtgcaacttttacaagtactgtcgttctatatagtaattttacactttgaatattgttttaaacactatactgtgagaaaatcaaagaagaaagatcaacttaaaaggagcgaatcaacatgcagccatctgaaaagccaacaacccataaaacgcgcaagccaaaacgtcttgttctcatcctcctccctaccctggttgttgtagtgttgggtctgttcttgaatcacttcaattactggccttttcagggtagcaaaatagccggtgtccctgatggtcagcttgttcaactagaaaataaaccagatttaacgggtttgctactggcatatggttcgcaactaaaattcaacaccacggcaacctcattaacagtctattttgatcactatcgcaaaggtgaattaaatactcatgactcagttgcttctttgacttatgaacaagatgtttccatcagtggctatctaaactttggtattgcggaaggacagaatcatttattggtgaagctattctccaatggcgccatgtcacaaacagtcaccgatctttccgactatgactttccccttacacaggaagacagacaatttggtgctgtgactactatcaaaaacggcaaagtgaaacttgagaaaaacaaaaaaatcccgctgctttatttagcagaaggaaatgatggactaaagatctatgatgatatggcgaataatctagcaccagataacttgaaaaccttgccaaatgcctatttgatttacctggaaattaaataacataagtccttataattatctaaattgaagcagctttctattttctatgaggagatatttttttgcaccaacaaattgtgaacaaaaagagtgctatttcttaattcgttttcctttacttttttatgctttttacttattattcttttgaaataagaataaattaaaataaaaaaggagagcaaacatggaaaaatatcaagtgtttcctggtcaagactatcaggcaaaggttattggctttagtggtttacaagatgttagcgttattcatgtttacgaaaatacagctacagtgttgattcaaggtacttctgaaacaggagttgcgaaactttgcaacttttcaatcaaaactgcatcattggtgggataaaactttcagagactgaggaaactgattttaggtacaggatccccaagacagaaaaaaggcagcccaattagtgttgcttcgttgaaacaccaaaatgtataaagtatttttattttatttattcaatatctctctacattatttgcaaataatgttaaaataaaaaaacaggagatgtatcaggcttcccccaagagaatcttccccaagtgctcttgcctggtacttcttccttgtttatttttcggaactacagaacaatggtaagccattcttctacgaatttcaagtggtcttattgctgagcaaaacaaagatttactattctatttccctcaaatctcccaataaaaaaacatttcttctacttttgttgataaatttccagctacggggatctgctgataatcctatcctcgaataaaaaaactgcgaaggcacttcttgttgaagcgtcccccacagtcgttatctatgacacatttctcattttgatttgaatccttctagtttggaatagtctctgtatatacagtcttctttccatacaattcctgtgtgattcctgaaagataatcggcagagttggtgctgcgaagattatacattaggaaaatcccgtaattttcagccttcgtccgtttagcatattgaatgctttgtgcttggtttcttcctacttctacagccgctggtcctaaacggtcggcccccattccaacaaagtaaggaacctgccaagagccataatatggattccagctataatcgatcgtctttgaaacattttcattatacattgaattctcggcagcgggaccaatattatatagtgtgatcagcttatctgtcccaagacgatttctcaatgcttgaataagccaaatgaatgactgatcatttggttgaggtgtcccattcttcccgtattctgcatactcatcatcaaaatcgattccatctaaaccatacgttttcaccacttgttctagctccgcagcaaacgcatcagcactggcataatctgtgaaatttgcaaaaccagctccttggtgatttcctaatatcgataagagaacttttgtgcctcgtgcttgtaacggtttaatctgggtttccttttcggctagtgttttttgtacttgctcatttaaatgaagataggcttgctttgtcgctggatcataattgatattcgcagcaaaaatgatcccgatgtcgattgcaggtttgtccgttccggctagcgtatatttcccaatgtttctaaattcgttgtcattgacttcaacatacatcactgttttcggtgtgacttgatcggcagcctgagcttctaaaaccggtgcggccaaagaaaagagacttaaaagaaccatcaccacaaaagcaactgtgaatcttcgagatggtttcactgctagttgattcttattgttcactgtcaacgcctcctataataatcagatatttacacatcatttatgaagagtttttttgcatagagtctattgttctgctgccataagcgcagcttctttcaatgggtcatattcagggctgaccgcttcttcatacttagcagccaaaaacactcgattcacttcataatgagaagtggcacgttcgatttgttgacttaattcttgaacttggcgatcggaaaactggtcgttctttctagcaagataatgtttagcaaaagcttgcgactccgccaaagagcagccttttgattccaaaatcgccgtttttgtccagagaaagtccgtcttcaacaactgatcgtttcttccttggataccatcgcggccaatcgcataaagaaacatgcctccagtttcagttgtacggacataatttgcgacactatagagattgctggactcataaggttcacgggtatctccccatgtttgattggtacgttcttcaggaaacgagagaccgactaaatactgagaccgttcgatacctgtctttgagaacgtgttgttccaagaagactccgcccgcgtggcattcgatccatattgctgcgcacccaaaatactgaacgctgatgaaacaggagtaaatggctctagggaaaagatatctacagtatcataaatcagcagtgtatctgtgtctgacttcggtccaatatagtgtgagagggcctcgatcaccccatgggcgattttcagttgactggtagtataagtactttccatatcaaaatcaaggccatcgattcctggtgtcatatatttatctaaaagctgctttgcataatcgtcaaattcttttgctgttggttggctctgcgttgtaggaactttcaatagttcgcgataatctaatcctcgtacaagctttgttcctcgcttgtgtaattctggtccataaacattggcgacttcatcaaaaaagactttactatctgcatcactcacatttgcgtggaacacattgaccacatcaataccataaggaatatctgtcattcggatctgattattttgttcagatggaatactttgatctctccatgtgcggtaatagaccataaatgttttttccgatttatcaacagtcgtggcagatccctcaaccccaaacaaaaacccacaaagcaacaacgaactagcggcaaacaatcccaaaacgacttttttcatcaacatccatcctttcagaataaaatttgatacactttatgttagcgcttacttaatgaaatatctaagaacaaattataggtatttcataacaaattaaagatttttctttaaagtaaaaaaagaatgcactaaaaaatagcaacaaaagaagccctctattctcatgagggctttcttatccttttcttgcgaaacggcagtctcctaaaaaagaatggtgattttgataacacatttttagagcattgcttagctgcgaacaagcaattcaaacggtaaaacgatttgttccctactccgttcctggaatagacggaacgcttctcgtccacagaggtgcaaatggaattcaacggttgaaaagttcagtaatcgactgatcagtaagttttcttgaccgataatcagaggtgcttttctttccccatattgagataatattgtcgctgcgatttcatctccattggtaatgatcccgtcaacgccccggtctttgaaaaaaacagccgcagcctcgccatcttctgctttgatacaatcccaaaaaatgtcctcttctgaaaacccgggaaagagctcctttgctttagcgatcgtattgatcgaattacagctgagtcgtttactgcggccaagagtcaagcctaaccgtttaacgccttgttctttaagataaaggatgctggctgtcactgagccaacttgatcgatcgttacaaatgggacatccgttccgctggcatcttcacaaaaaacgataggaccattttcaagataggggcgaaatgtctcaatatggttggcacgagtgatgacaatcaatccatcgaaccctttggcagcgaactcttctaaatagtccttctccaaggctttatcgaaattagttggtaaaagcgtcaccttatattgttgcgcaaatgcttcttccataatgccatttagtattctatcgaagaagggatggttgacaaatggtacgatgactcccacattgaatgtttttcctgagcttagtttctgagcgatcttattcggcttatagttcagttctttcatcatggctaaaatggtttgacgcttttgttcttccacatacggatggccgttgataacccgggaaaccgtagtgatggaataaccagtcattcttgcaatatctcgaatcgttgccataaacagttgctccttatgctatgtattttcactgctgctttatcttcctctgtctagttgtagtctaccataaaaggaatataaagacagattgtggggatgaaaaggaagatttctctaccataagtgatagacaaacaacccgaagtagttctttctacttcgggttgttgattattcttcttcattcctatctcattttttctacaaaggcttttatagaaggattttggcagccagcgtcaaaacattccaaaaaacgtggggttaacgcggtgcgaaccaaagctggatccagtgctttcaaacctgacagtagtggttttgccatcacttgttttacttcattcaatatttctgcattgcgattttgtgatgctttccgttctttaggatacccatttcctttgttagaaccaaaagcacggtcgaagattgtttccaggtttagctctgcgccccagccgaatcctttagcataaggcaaagacagggcattaccattattgatttgcaaaaaaagatatgcgtcggttggttcgatacaatacccgcatatcacaccgggataggcatttagagacattaatgcgccttgtccagtgccgcagccagtcacaataaaatcaatcgctcctgaatgaagcagcagtgccgcttgaatacctaaatgaatataagtcaaacgtggattgtctttgctgtaagcttctggcagatcttctgataataaaggttcactcatgccaacattataaacctcatgaccatatttgttgccgattgttgtcaattcatttaggataattggattctttgctgcctgactaaattcgttcaaaagtgcgattttcattcttttccacctcatttatttttaaaaaaagataattgaaagctgccaaagcgttttttttcgttataaaagcggccattagtgagtcgttttctgtgaaatcggttaattcccgataaaaatgtttgttctgtctaatttcaatcggggtctgcattctagtggccagtaaaaagaccgtgtccaccatttcatcctcgtaccaaagaatgggttctttcaaaaccattattgctactttaggttcaaatacttctgtcatacttccatgtggaatcgctgtatgatgaccgatacaggtagttgtcttttgttcccttttccaaaccgtcagatagaaatttggcgatacaaaccctaaactttctagttgattggataaaaatgtcacgacttcttctttgtttgtatatgtttgatttacgaagatcaatcttggatccagcaacggcttggatgcatcggaaaaaatagagattgatccaggtacaattccccaacgagaaagagccgttcgaatattcacaagatctttgtttgaaggaagataagaaatcggaactgcagtgaccgaatctactggaaccatcgttaaataaaggacatcttttctggtagagtcaatttcttcttctcgtataatatgaatctctttgatttctggaatattttttttaatatattcagtggcaaacaaactttgggaacggcctcgatccgttactaaataagcatcaacttgactttgatttctcaatatagcggcttcgatatacaaaacgatgtaagcagtctcatcttcggttaactgtacattatagtagtcctcaaataattgacttgttgaccaaacactcaaaaagacgcgaccatagagttttttcaagtctcgggtcaattcagatgaatttttgtgcccgtatttcattcgaaaaatagcagaacgaagatggtttgtcagttcttcttccaaaattttgtcttccgtcaatggctgttgcaaaatttctgaaatagatgaaatgattgtatgaacaaattcaagcaaatcgttatcatactgattttttaaattagtgagtgctgccgaatccttccagcgcaatttatttgatacaagaatttccgcagtaagtattcttttatctacctcattgaatgttccgaatcctcttttttctaatccacgataaagggtttcaacaaaactatattcattggtgtattctctttcaaaatcatcaatcgttggcatatcagaggcataagaaaatcttccaatgctcaaaatcagcatgattcgtattttgataaacgaggtattagaaaatttgattttccaatcactttctgcttttcgaataatctcagagatttcttcaacagatattcctctggcaaatcgttgcaaaacaacagtttgtttttcatcttcttgcagaaggatcgcatctcgaatcgctacccgttttgaatattcatcacctaccaaagtaagtccttttccgggaatcgtttgaatcataatatgatgatcagcaaaccattctttcacatgactcattagttttctgaaagtaggtatactgacatataatttttcagctaattctacttgagtgataaagtgattactcgccctttccaacagcaaacaaattaatgtccattcatcattttgggaaattccttcaggtatagaaaaatcactgaaatgttttaataactggttttgtttatttggatagagcacaaataagatccctctaccaggcttcgtatcaattcgtccaagtttattttctaccaacaaatcatcgatttgggcgattttcctccgaatcgatttttcagatttgccaacatattcagctatttttttgatagaggtctccggatttttctgaagaaaacgtaagatctctctctttactaatttgtcttttatcaaatccaaagccctcctatcagattctgcctttcatcaactattcatgacccgtgtaagtaacctcgccaaaaatataacgatcctttgagccgattacctcaatgtaatctttcacaaattgcttgactcctgcttcagcagccatacataaatgcatataatccgtttgctcgtctttttttagttctctcatcatggcttcttttgcaacagtgaacgcatctgtagccacattgattttattgattcctaaagaaactgcttttcttaaattggctttcccgcaaccacttcctccatgaagcactaatggcatctgcaacgtttcttttaactctgctaaacgctcaaagtctagttgtggtatttttcctttggggtagttgccatgtgcggtaccaatcgcaacagctagagcatcaacatctgttttttgaacaaagtgtaacgcttgttcaggatttgtgtaaagatccatatttgcatcatcttcgttcagcgcttgtcctacatgtcctaattctgcttcaacagaacagccaacgctatgtgcaagactgcagaccattgccgtcttttgcaagttttcttcataagacagacttgaaccgtcaaacatgacatttgtaaagccttgattgatacattcagcaatgacttggaagtccatgccgtgatctagattcaacgcaacaggaatagtaactctggctgccagttccttgatcaatggaatcatttcttctttatgtgcatgatttttcatttgaccaggaccgaattgaatgatgatcggtgaacgctgttctgcggctgcttcgattcctgcacgcgccatttcaatattgatactattcatcgccatcacaccataataatttttattggcatcttctaaaattgatttcatacttactaacattgttgtccccctcttcttcatatgatcgcgtttcttattcttctaaagtaatgtcaaaatcgaaatcgtctgtttcactgttttctactgtttcagtttctgctaccgtttcacgtttgatgaccgcatagacaacgccggtaacaactgaaccgatcaccagagctacaacgaacattaatggattcgtcatcattggtatcacaaaaataccgccatgagccgcaactgattccacgccagatcctaccgctattgctccagcagttgcggatcctaatacggagctgatgatgaaacgaactggatctgctgccgcaaatggcagtacaccttcggttataaaacataaccccattggaaaagcagctttagcggtatcgatttgtgcttgtgcaaatttttttttggctaacaaagtggcaatgaatgccccgattggcggtgtcatccctccaactagtttagccgccattggaccgttgattccatctgctcctaatgcattggctgccagtgaagcagttttattgataggcccgcctaaatcaaatcccatgcaggcaccgattaccccaccgatcacagactttgctccgccattcagcgcaatgatccattgttggaatctatccataatgaaagctaacggtggcgagaaaatcattagaaacaacatcccactaactaaagtaactattactgggataaccaagaccggcatcaagccttgcatccaacttgggactttccattttttcacccaattcacaccataaccaatcacaaaagcgaccagcaagccccctaaaaatccggcttttgtttcattagcggtatatcctaaaataagtgctggtacaatagctggccgtccagcaatggaataggcggtgccagcagccataaccgcaaccgcaaaggccattgcataggaactcagcttgttgactccccaccaaaaacctgtccacgtataaggatccatctcagaaaacggcgtgactcccggttgaactaaatctccaatattgtatccgccaaacccttttgctagtgcccccaaaataccaccggctacaatgatcggaatcatatacgaaattcctgtcagtacgtgtttctttacctcaaatttccccttcatgtatgctactcctttccttgatcataagcctaatttttcatgaattttcttgattacaccttctggtgatttcatgatcaatgctatgggaatgtcaatgacttttttccctttgaatcgttcccgagatacgccaatatccgtagctagcaacacgatatctgcttcacgaatatctttttcagttaattcattttctaccccaatcgaaccttgcgtctcaattttcacatcatccccagcttttatggcagctttctcaattttttcctttgcaatatacgtatgcgcgattcctgctgtacaagcagtgattccaactattttcattttcttcctccttaaatctttaatcgatcgataacctcatcaactgagtgggttatttttaatcggtttaatagttcatcatcacttaattttgctgcaaccttactcaacaattgcaggtgtaattttgcaccagatacatcgtccggaaccgcaaacaaaaagaaaaaattaactggttgattatcgtaagattcccagtggatcattttgtttgttttaccgattgcgattccagctcgcatgaccgaatctgatttcccatggggaattgccacgttattccccattcctgtgatcccttctgcctcacgctcgtatacagaggcaataaaatcgtcaagtttgctgagataattttctttgtacaatagagtagctaattcacgaatcacttcgtcttttgtgctggctttcatatttagatcaataacattccgatcaaatattgtttgattttcattgactgtttccattctttcgctccttccatctcttattacacaaagaataacagaaaaaaaagaaagcgcttttaaagaaattgggaagagcattgtggaatttttttctttgctgttcaatcatgactttcagataataagacctgggcatttataagtaaaaaaatttatagataaaaataaaagcccaaaattttttgggcttttcgggttagtagatttctaatattataaaattaattattgatggagaagaacataagccaaggaaataagtaccctaagtataatagtataattctaagccttatttgctctttccttaaacacatacatccagcccgttaggctaatcactaaactggctaaaacaagccaaaacccggaatcaatggtgattctcccctctgcaactagcttctgtgaaccaatgaccatgtctcgacagtaaagaaatgttccacctgcaccgataattagggagacaatcaatgtagtataaatttcacctttactagcattgtgtccaaaaaaactgccgctcaacatttgatagcctactatcacactacctacgatccccatgagaaaaaacgcaaaatcactaggattactgaaaaaacccggcatagtaaataataatataaatccaactttcaatccccacttatagctattgcttttcaactgattctgccgttcatcataagactctttttccattctactcactgatcgaagaagtaatccatagaagagataaaagccaagaataaataagactccaataaaccaatagcctacccaggtaaagaaaatcaaatttgctgctacccacagcacgtgtaatactttctcaaaaatacttgcccacttgtttttcattcgtttgtgcctccagtcaatttaaacagctcctccactgataatttaaaataatgagcaatccgtaatgccaactctaatgaaggattgtatttgtgggtttcgatggcgttgatcgtttgacgagaaacgcccataatcgctgctaattcgccttgtgataatccttgttcctcacgtatgcttcttaaacgattgatgactggcatcttctcactcctgtcaagtttcctttacatagaagttaccatatttcacagcttgtgtaaagattcctttacatttccgattttcgataaaatccaatctatcctccaaatacaaacttattccttcaaatgttagatatagcccctcattagtaacaaaataacttatcattctattttgacaatataatctgttaaaatgaatgaatcccacctataaaaaattgattggagtgtacgagatgaagaaagtattaatcgctcttttttccgtcggtgcaattttaggactgtcgatccatttctttggactacagatcggactcgcactttttaataaaccgatctatatgattccaccttccgtctatcgattaacaaaagatgcattaacaattatggagaattatggagtatatgcaaaagagacaggatttgagaaagaaataccaaactatctagctcaagtcaaaaaagacgatacgtttgatgatgttgtgcccatgctcaatgaagccataaaggaagctggtggtgatcattcagctattattgaagtccaagaggataaagcgccacttttcaatccagctctgcttactttccctagaatcttggcagaagacaacattgtgaccctcattttgccttcatttcctgctagtgatgaagaaaatgtgcacacttacgttactacagcactcgaacaactttccaagatttctgatcccaaaggtgtcattattgatctacgagggaataccggtggcaatatgatgcctatgttaggggcatgcgctcctttctttaaagaaggtaaactattcgaatttacttctcctaacaaaaaaatccccgtcttcaagaaagacgggaaaatatgttttgaagaagataatttaagtctaccaactaacttaaactttcatcacttgcctattgctgtcttaacagatcatcagactgctagttcagctgaagttgtactggttgctcttttaggacaagaccatgtttcctcttttggagaagaaacagctggttatgccacaggggtttcaatgattcctctttatggaaaatacgctttgtccttagcaggtgcaaaaatcaaaggttccaatgggatactgtatgaagaaaagccaattcttcctgatgtcataactgaccacccggaagatgctgcactaaaatggcttaagtccattcattaaccagcaatttgagaaaatccttactaaaaatactttttttccttagattctgacctactctatctcagcgccttcacaagcgctgttttcaagttaggatttttgaaggacaccttttttagcatagcgccgaaaaacacgatggaccagtttgctcgctaatcgttggataaagacggaatagttgagtaatgcgatcaacaaaatcaaattgatataggtcgtattgccgagattaaatagatctcttccgacaatcaatgcgataaagtagaggagctgtgtgccgaagaagacaaatgttcggtacttgctgtttggcggataaattttccgctggatcaagatgtaattccatgcagtaaaaatcacacacatgatcgataaagcttgaccactgctgccgaacaagtgcccgatattaataataagtaatgttccaattgcgattgacagcgaagccgggaaggcatttttgaaaatagtagacaaaaaggcgcctttgatccgattgaaatccggttcgaaattcaacaaaaaggtaggaatgcctacaaaacaagcattgatgatcgtaagttggatcggttcaaaaggataagcggtccccgataacagtgttcccatagtgatcaagatggagaaaagcacttgaaccaaaacgagcgaccctgagcgggtaatattattgatgactcttctcccttcatccagtaccgaaggcagcgccgaaaactggttttccagcagaactaaatttgccacttgtcttgctgcatcgactcctgatgccattgcgatcgagcaatcggcttctttaagagctaggacatcgttgaccccatctcctgtcatagcaaccgtatgattcatttcttttaaataaatgaccatttcttttttttgctgtggagtcactctaccaaagatctgatagttgccgactacctctttcagttcttcggaggtaagcgtcgaaacatcgatataatcagacgctccgggaagattgacttttttggcgatttgactaaccgtgaccggatcatcgccagaaatgatcttgcactgaatggcttgggatctgaaatactctagagtagctttggcatctgatcggaccgtatccgataataagaaaaatcctaaaggttcaatcgttgcaggtaactcatgattttcgcaaatctgagggctatgtgccaatacaatgacccgatacccttgttcagccagcgctcgttcttgttttaaaacaggggcatgctcgttggacaaaagaatagaggccgcaccaataaagtaggtcccttttccttcaaaagaaacacaactgaattttcgttccgaagaaaaaggcacgacatgctgcatcgcatacgtttccttctctggaaagaagtctcttaatgccatggccgttgggttcttgtccggtaaatgtgccagtagattttgcgtgatctctgccatttcttcttctgaggtaaaagggatcactttctctactgtcatttgtccttctgtgatcgttcccgttttatctaagcaaagaacatccactcgtgctaacgcatcgatacagttaagctcttgcaccaagactttttttcgtgccagatagacggcactgatggttaaggtcacactcgtcagtaaaaataatccttctggaaacattcctacagctgcggcgacagttcgcaaaatggctttgttgaaagaggcatgcgtaataaaatattgtttaaggaataacaacgtacacaatggaatcagaatcatactgatccagcgaatgactttgttcagacttccttgaatcaagtatttttgccgcttgatcgttttcgcttccttattgattttttcaatataattttcttcgccgacgtggatgacttggcaaaatgcctcaccggctgtgacaaagctgcctgaaaacagttcagcatcaggttctttactgatgctatccatttctcctgtcaatagcgattcattcaattccaatgaaccttcgatgactttggcatctgccggaacttggtcaccattcttcaataacagaatgtcatctaggactaatttatggatcggcaatgtttctaaattgccatcacgatacacattgactttggcaacttttaacagcgccagtttatcaagggttcgcttcgaacggatttcttgaaacatgttaatgatcacattactaaaaacgacaaaaacgaataagccattctgataagaaccagttaatgccactaagaaaaagaggaggctgttgatcagattaaaaaaagtaaaaacatttgtaaaaatgattttcggatacgaattcgtcttatctttctttgatttgttgacttctccccgttgaatccgtgcttttacctctgctgaggttaatccatgtttgttttcgatgatgtctcaccctttcttcttatcatttgtcatactctcattccatcttacgtaagaatggctggttaatctataggacttccggttggtttttgcggaacttttattttttatagtctaaagaataatttatcctctcataaaagatgacctaattgtgtaaaatatagcataatatgctgctgcttggcgtttcatttttgtcacttcactgtcacgctttggcataatgttcctttctgacctcgtttgtttagtacttgaacattcagcaaccttgttctatcaacgatactcgtaatccctttctgctaaaataaataactagagaggtatcatcttttttgcgggttgttttttatctttagaaattctaaagggttggaatgaaagttaaaagaacacgcttcgacaaaaaaggctcaaaaactttttatcaaagtttttgagcctttaatgatttccgtttttttgatcagtaaattttcattcacaagtatcctatgacgctctgactaattcaaatgtttctgatccaaagagtcaatggcatgcatgagaccttccaacccagcaatgattttctcttttggtgcacctagattaaaccgcaggtaagtcttaccttctggtccataaacctcaccattcatgatcgcgattctttcttgttttaccagaacactttgcaattcatccatactataaggtaaatcttttatgttgatccagcctaagtaggttgcttctggaatagtgaaatgaattcgcggatcagcagacagtatcttctttgcttcgaaaaagttctcgtcgattgtttgattgagttcaacggcccatttcttttgattccgataacagtccattgtcgctagtagtgcaggatatggaatcgacgatagaccatctcttgctttcaatatcgtcaaaaatctttctcgtaatttttcatccaaaaagatagcataagagccacccagtcctggcgtgttgaacgtctttgatgcggaggatagcaaaactgcaggcacctctatcgaatcaataaattctaagataggtcgatgtttttctcctggacgccggacatccatatggatctcatcactcaagatagcgacgttatgcatttggcatagcgaaaccaagttggatagttcttgatcagtgaacactcggccagttggattgtgcggattgcatagcagaaaaattgctggtttttcgatagcaaatacgttggctaaagcatcaaaatcaaccgtaaaccgttccccatcattggttaaggaaaatgggatcaactcccgttcgttaccggcgatacaatgataaaaagcatcatagcatggagtaaatgttactactttgtctccttttcgacttaatagttggatgcaaagagataagctataaatgacacttggcgagtagacacaccagtttggatcaatcgtacaatcaaattcctgcaaaaaccaatggctgatgctctgcttataatcaagatgattccagcgagtataaccaaaaaaacctctagtcacagctttagccaatacttctttggttccatcagggatcataaaatccatatctgagattgagaagggcaatagccctttttctccgaaacgatcttggacataatcccactgggtcgaatacgtgccgtagcgagagcgctgttctttaaagttactcaagatcgatccctccttcatccaaggaacgaataaccgcagaaatcaactcgatcgtcgcttcaacgtcattgatgtccacgatggaatgccacgaatggcaatagcgaaccggcacgcaaaagactagggttggtttaccggcatctaactgaaccgaaccagcatccgttccacctccggctaacaaatcatattgccaaggaatttgattgctttcagcaacttccttgcagtaatccaacagctttatatttcctaatgcggttttatcggccagaacaagacctggacctttgccttgaatacgattaggatagtccgcagcttttggcgtatctttcccattggctacatcaataacgatattgatatcggcatctacttgctgcgcggcaactttcgatcctcgtgtcccagcctcttcttgaacagtccccacaccaatgatttcgacatgttgcgttttaatctgatttttgatctgagccatgatcgtacaggcaacacgattgtccaatgctttaccaataatcttctgctgattataacttttcttggcttgagtatttggcaaaatcatatcaccaatctgcaaaccagcagcttccaattcaagttttgatttggccccaaaatctatatacatctcactgattggtactacttccgacattgcatgcgttgattttggcagcgttcccaccacaccttctatgatagagccgtttttacgacaagttgctcgcacttgctgccccaaaatgacatgcccccaccatccaccaatcggatagaagtagacaaagccttcctctgtgatacggtggacaaaaaaaccgacttcatccatatgggcatagagtgcgatttttttcttttttgttgtcaaatctccaaaatagaggtttccaaatgaatctttgacgccattcgaatcaatgatcgtcatcagcacctcttgcacttgtgactcttgaccaggcagtgcatctaaattagaaagacgcattaataatttatcggttgcaatcaatagttatccactccttactgaatttcgtcaaaagttcagcattccccagatcatttactaatatatcgtcctcgatgcgaataccgaatttttctttcgggaaatagactcctggctcaattgtgaacgtcatattggcttgaattgacaactcatttttgggtgctacggccggatattcatgacaagaaagaccaatgccatgtcccaaattatgactaaaatgatcctcaagtccctctttcctcagtgcttgtcttgcaacttgatcaatctctcctaacgttttattgaaagaaaccttttgaacagctgatttttgagctgccaataggatctcataagtttctcggatctcgggttttacttcgccaaagcctatcgtccgtgtgatatccgaataatacccgtcgtagatcgttccaaagtcaatcatgatcagctcattcgcttcaagttttttctgactagcatgggcatgaggcaacgcggtacgctctccggaagcgacgattgtttcaaaagccgggccttcgctacctaatttcttgctacgataatcgagttcattcgctaagtctagttctgtcatccctactcgaatcattggcatgatccgttctaatgtttgatcggcaatctgcgccgcctgtctgagggcacaaatttctttagatgatttgatcattcttaaactttccaccatgtttttggtggtgattagctgaccattggcctccttcattaaaaagtgaagctcagtaaaagtctgataggaaatggtttccgcctcaaaacctaccttcattcctgcaataaatggtcgcattacttcgatcaaatgacttccaatcgggatctcacaaatttccacaccagttgtttgttgagacgcttgttctgtataacgaccgtccacaaacaaagttaatttattttcagtaactagtagtaagccgtttgaccccgtaaatccgcaaagatagcgacgattcgttttatctgtgactacaagtccggataattttttttccgctagttttgctcttaatgcatcgatcctcatctattttcccctcattccttttctaacctgaatcatctttaatagttgattctcgtctcaagggtaaacaatatactcagaatagtaaaaacggggcacaagttcacaagataagtgatgaccgatagaatggtttcttttgcaagaggactagtaccccaatttaccagacaagattccccacactattgtttatccgctacttgttctaacttatgccccagcccctttggctagaaatcaatatctgttaagtattgttcatcttcatctgagatgactgagttgcctttttctgcttctaataatgcttcccgctcgaattcttgtttctccaatactttgaagaatggcaaatataagccaaaagataaagcgacttgaatcacttgaatgatgactgctcgccaatcgaatcctgtgagaaacccttccataaatattggcacataaggcggatcaaaaatcgggtagttcagtaaacctagtttcatacaaatcattgggaacattcctactaatgccccaccaaagataaatggaatcatcaaaactggattcaagatgatcggcacaccgaacaacacaggttcattgataccaaacatggaagggagtaaagcaactgcccctacttttttgtatcgttgtgacttactgatgatcattgctaaaactaagccaatcgtcacaccagaaccggtaaagttggcaaaggccgataaggtaccattcgtaatgacatggcgtaatggttctcccgcttcgtgcgctgcaatgttctcggacaaatattgcactgcgattggtgaaagaatcggggaaagaaccgctgaatggataccaaaaaaccagaaaaccaaccgtaaaactaatactagataaatcacccatagcgaatctagactgccaatagccggtgctaaaatatccatgatgacttgcggtaaaagaacacccccagataaactatcggtaaccgcacggatcacaataaacagaaccccgatagccgcagtgggcgtgatcaattcgaaagaactggaaacaaaatccggaaccccctctggcattttgatcaccaacttgtgcttcgtgaagaattggtagagtttgaccgaaataatcgctatgaaaattgcagtaaataagcccttagaatcaagatagctggcgacgatattgccgttgtcatccacatccattgctacaatcaaaaaggcaattgctgacaacatcattgatcccactgtataaagcttatagtgttcacttaagaaatacgaaattgctagaactgcatacaaaccaactaaccctaatgaaacttttgaaataatcccaaaaatataaccgtagctttcaaaccaatttgcaactccctgtgtagtaatgaactcaggaatagacggaaaaattgctgcaacagaccctaataatagcactggtgtcattacgaccattccttttttgatcgcagtcaagtaagcattactatcaactttattagcaaccggcaccaatgttttacgaataaatgcttctactttttcaaaagcaccctgtttttttggactttccatttttttcactcctaattattgagttttcaatgcttcattcttacgatatgcaaccaacgcttgtttcattaccgtagccccatccatggacccatagatatccgacgttaataaaacagttggtttgttcactttatctgcttcccctttaatgaaatcatatttgtgactcaattgtggcccaactaagatgacatcatagtcattgatatagcgttccaatttgtcgacaccgattgcctccattggatagtctttttcatctaagctttttgattctttgacaacttttttcattgactccatcatcattgtcgttgagaagcctcctgcacaaacaagcaatattttcatgtttctttcctcctactttttttttgattacttattttcttcgcttttttcctttaacataccaatcatttcttcaatcaaatcgcgtgccaataagcttgtcattaaatgatcctgcgcatgaaccattaatagactagtttctgttttctcgccattcagttcaccggtaatcaactttgtctggacatcatgggcatcaatactcctttctttggcttctttcatttttgcttctgcctgttcaaaatcccctttacgggcgaatcttagcgcttcaaaagctgctcctcgcgaatctcctgctgcagagatgattttaaaaatatcaacttctttttcgttcattgtttcatccttctttcattaaactttgtatataagacttaaagtcttgaaaattcgtgattttggctagttgattgtctaacgcttggtcttccatcattttgatcatcaatcgactgatttctttatgcagatttaaatgatctttcttgatattgatcaagaaaataaccttgatttcttttttactgtaccaaattgattttcttaacaaaatgacatcgatgacttccctgatcgctgcctgctccataggatggggtcctgcgataccattttgatagatggtatcgatcattttttctctctcaagaacactgtgcttaaatccctgctcggcccacccatcttctaaacgagccgcttcgctttctagtagttgcaaataatcttctgattccgtatcaatttgaaaccactgaggatcaaataaactgagaataaactggtgtacatcaaatactttattttccgattcccgcaataggcttaaatctttttcgattttattgatttctgcccgatttaaaatcgtttttgtgtagatgatagggatagcaaactgttcctgatccagaggaacagtggaaatcagtaagtcaaaacttttatcaatctgatcaacttcgttcaaagcaaatgtggtgacttcagcattgctgaaaagccgctctaaattaactttcaataaataagaagcaccgccacccgtagaacaaatgacagctatttttttataatcatcgattaactgattcgcctgcttctcaagactagctgcgaaatagatagcaacgtagcctatctcatctttgctgatatctgcgtccaagtccttgtttaattcactgatgaacaccatcgcaacgttgaatacattggcatattgcgtataaatgtcatcaatgatcggattatctagttgatgtccggtatacagtctttgaagtaatggagcgacatgcatcaacagggcattacctaattcttgatctgttctaaactgtgtatggtaacgtaaatcgacaagctctagtgttttttcaattgcttgtttcaattgctgattactggttcgatcatcaaggaccgaaaattttcctctcagttgctcatgcaaataatttttttccatagtagaaaaagtaatgggataagccgtttccaaataggagaccaaatcttctgttaaaaggtcatacttatcggttgctgtccttacggttcgttcgtcattcgttaaagtgttattttgtgtgattcgaaaaacaagcaatcgaatatgctgtatgatattctcaaaaacaatatcgctcgctttaagttgatgctgttgcaacttttctgataaacaggaacgtagcgcctcttcatcaaagacgaagtgaaaagctttatatcgttccgtcaggacgggggtatggataatgttgcgaatcaaataaagaattgcttgtcttttcttctcttcagtcccgacaatcttcaaaccataatgtgctttgctgaataaagttaatccgtagtccttgcaaaacaattcgacttgtttgatatctgctttaactgttgaaagacttacctctaaccattctgaaatctgctgcatcgtaatgtattcttcatgaaacagcaggagaagttcgatattcttaattcgttcgttcgggttcccgttatcgatcttttcttgacgttttgcatgagataaaaatcttagaaacttttttttatcagaaatttccagttgatagcctgccgaacgaatccgctctattgaaaatccttctgttcgtccgatatctcttaaccacttgatatcattagccaaggtccgctcagaaatctgaaattcagcggccaatgccttgggagcaattgcttgcttctttgcatataagtattcaacaattttttcttgtcgcataatttcctcccgccttcacataaactatacaatgtaagccctttacttaaaatggcaactttttccgataaatgatgcaagaataatctgattcaaaagaataaccatttccttctacgagcaaacgattcggtttacataaccgggatcgatcgatatttttctgaacactgctgatcctgcatcatttcagctgttagcctcattcaactactccattcgcattctaaaaaagataactaatatacaaaaacaagccaaaagcctcgttacaaagctgttggcttgttcaatacagaaccattattgatcgaatcgattcttctatttttgatcaagtatacttctatttatacaccctaatcgcaggaggcacaaaatcagtgacaaatgcgttgatttcggcaagtgattcggcgaaaagaattttgtcgaagtcttcttgggtcaagaacccttctgttaccattgcctggtattgttgtttcaatggatcaaaaaagccgttgaaattgatcagcacacatgggttggcatgttgcccgatcctgccccaagagatgacttctgtaatttcctcaatggttcccggtcctcctggcaatgccacatataagtcagccagctcgatcattttttgttttctttcatgcatattcgagacaacgatcagtgacgtaagattctcttttgctaattctcgtgccaccaagaattctggtatgatgcctgttacttcacaattttcttcaatagcggtttcggcaattattcccatcaatcccgcattaccgcctccatagacaaggttatactgattttcacctagccatctacctaattctttggtgatttgcttgtattcttctgaacttccgatacttgctccacaatagactgcgacattcattctcaaatgatcccctttcgatctgattgcacttcatgttattatagtcgagaaataaggagggctcaatatgaaaatcaatgaatacaactcatgggtgatcgacttttataaaaaacggaactggtatcaatatgatccttttattcgtgttggatttcttacggaagaagtaggagaactatcccgggccattcgcggcgttgaaattgggcgagatcgacctgatgagtctgcaaaagatcaagcctactatcgagagaatttgatggaagaacttggcgatgtctttgacaacgtattgattctcgcagataaatacgatattgctctcgaagacattatgggtcatcataaagcaaaactggaagagcgatttaaagaggaaggatagcctagctgctaactatcacttatatttcttttcctacgcgttatcttgcgttatcctaagttgtgcgcccagttgatcacctgtcattgtcaacgagttagctaagggaaaaatattgtcagattttctagtctacttgaagcaaaaaaaagggactgtgccataagtctcctacaagtaacactagccgaacattaatgattattgctcctgcggtgcagggactcctcgtcgcaaaagtcagagggatctatcctagcaacagactattattcggtttaacttgttggatgatgacttatgtcatagtcccgtattataaatcattattacagatcaacgattgaattttttgctgcctaatttcatatgaaattgcggatcttttggtgtggaaggatcgacacctcgcaaatgaggaatttctccacagatcaattgcaataagacaatgaaattgaacgtcataaactctggatcggtggtcacaggtaagaccagatctgctgcgtctgactcataagtcgtaatcagaaaaatagtatccgaccattcggacaaaacttctttcattttctcagaccttggctcatcgccgttgtctaaaataaagaccatcgaatcttcattgatcgcattatagatgccatgaataaactcttcaaattcatatccactcaccggacaacgcatcgtctctaacaacttcagggcactttctaaaacatctccataaatagctgccggaccagtcacacggatttcttttgcagtgactaatcgttcctgatttgcagaaatccattttaatgaagtctcataaacagcttggaactgtccagcagcagttttcaccccttggatctgttgttcaaatgtctcttcagaaatcgttccttgctcaagtcccagatagagagcaagtaataatagattcagttttgtacaataaaagccctttgtttttgcccctgctttctcaggtccacaatggacagtcagaacaaaatcagccatttcatcaataaatgcttgttcttctcctgccatggaagcagtgatacaacctttgcttttcgctagtttcatagcgttgtaggtggaaaaagagctacctccttgagagattccgacaactaatgtctgttcattatcacttaaaaaagtctcttcagtgatcgtgaaaggatagaccgctcttacttcaagttgtaatagtttttgcatttgcggagccatttgcaacgcggaatgatagctcgttccagaccctgtcaaaaaaatccgagtgattttttcttttttgatacttgaaaaaagacggtctcctttttcgataatttctaacaatttacttggtgtctcttgtaaatactcttgaattgatgccattttttctcctccaatattatagaatgccaatcaaatgaacagcgatcccaaaaataataatgccgatcgtaatcttagtaatgctcgctttttttagcagcttataaatgccaaaggtgaaggctagcggcagcatctttggtaatatctgatccagtatatcttgaaccacgatttctgctccgctgatattccactttaatggagtcgtgatattcagcatcgtcgccaccatacctccaacaacacataatccaacgatcgttgctactgccataattttatccatcaagccctctttttggatacggtccaacgaattgacccctacttgataccccagtttcaatccaaagatccgaaccaatatatttggcaaattatacaaaactaaaaacagcaatggaccaaaaagattgccatcttttgcgatcgatacaccaataccggcagcaatgatccgaacagttccccagaagatcgaatcaccgatcccagctaaaggccccatcagtgatgctttgacagcgttgattgattggacatcaaaagccggattgttcgcattttcttcttccatcgctgcgctgatacccatgatcgttggtactaccgctggtgtcgtgttgaaaatttccaagtggcgtgtgattgctgctgcttgatcttctttatttctatagagctttttgatgactggcaacatggcatacatgtaaccgacattttgcatccgttcgtagttaaacgcaccttgaagagcaaaggaccgccagaatacactttttagctgcttcttctcaatcttattcaaaatcgatctctccttccgtcaagttatctgggacactggggatagactctttcttctgttcaatatagaagtgcaagatcactgcgatacaagcaccgattaaagcaatcgcagtaatatttagtcctccgtaggcagctgctaaaaagcccaagaaaaagaagggcgccattttctttgaaaaaagcatgtccagcaacaaagcaaatccgatggcaggaagcagatttccagctacagataacccatctaatatgacatttggaacagcttcgatcattcccgttaccttatccgcacctaataaaatagctaagaaggttggtagaaatgtacttaaaaagaacaaaccaactggaatccacatacaaaaggctaatcctttgtaatttgcttctttcgcatagctatctgctttgtgggtaaaataagcattgatgatccgaaccaatacgcctaaagattgcgctaaaactgcgattggcacagctaatgctaaagctacttcaacaccgctattagacaaaatcgcaaatgctgttcctaaaatccctcctgtcaccacatctggcggtgtagaagccccaataccggcgatccccatccagatcaattcaagttgcgccccaatgataattccattctttacatcgcctaaaaccaaccccaccaataaaccggtaacaagcggacgatcaaacatcatctgaccaaatattctgccatctaaaataccgattccagcaattaaccctaacattattgcttgagcaaccatcgtgtaaccctccttcttctaaatgtcaaagtccgtcaacaatttctttttatctctaggcagcatccgaaattctacttggacaccggcatccttaatcatttttaagttagcgatatccttttcgtccactgccactagatccgttaatttctttttcccctcgccataacgcaaacccccaacatttaatgtggtaattaccccacctgaagcttcgaccaatcggcgagcatcctcggtcgtcttaactaaaaccaagacattactcttttttgatgatgcaaatttttgaacgatttctccggattccgctactcctcgaatgtatagaacaacattggaaggtttcgccagatttaaagccatagatttcatttgatcatttttggcatcgtcatttaccactaaaatcgtattgatccctaaggccgtcgtccagccaaaagctacttggccgtggatcaaccgatcatcaatcctcactaaagatatcgtcattgttttgtcctccttgctgtttgattagttgattaatgtgtaaaattcctttcttcccttcttctattcccctaagtacccaatcctcaacagatagctcagctgtttcctctgagagtatgagagaaagtaacataggtaaattgacaccggtgattaactggaattcatatccgtttaataaatgattggtaaatagatttgccacacttcccccaaagacatctgttaggacgatcaacgtctgatcttgattctgctctaagtaagcagtcatctctgcttccgcatcatcactcgatttttctttggtcattgaaaaacaatcgatctcgatatcttcaccagcaatcaatttcaaactatcaataatccctttagaaaatgtgccgtgggttgctactaaatatttcatctcttttcctcctcactacacttttttataatgcaaaaagcgtgccaactagtgacacgcttcgaaaagtcctcatctatcagtcaagaaaaaggatattatggatatagcaaatttctggcaatggaatctgcacactatagattgtttccagcacactgaccgcatctttgatcactctgatttcacgttgatgaataaatacaaattgttcaagatctgcaaattcggtaatttctacttgccgtatcaaacgctctaccatgcaggagatatgaacataaagaccgatttttcgtggattcgttaacttcagtgctaatcgttcttccagtgtgacaattaattcttctatgatcgacatgattttttgagtatctaaaatagttaacgaatcgaggactcgaatgagggaaaaattttttaccatccgatcattcacaatcttcatgccattttcatccaaatcaacgccaaagatctctgacattttttgcgcgttcccaccagagataatggtttctaaataaacaaactcggcctctggaatcagaggatcgtcggttccaataatgcctaataaattatagtgttgagaaatactagcgggtatcccgttggtaaccaattcactatattccatagggaaaaacgctacctcaagcaatccttccaaacattccgacaacattttttgaatctgaatcgctgtacctatcccagtaaagcaagtggtgattatcgcgtttttttgagccttttccggttcgaacagttgaatgttcggtgagatcgattccttcatccgttccgcaatctcggttaaaggagtgccttgaagcatcatattgccaatctctagtgccatcaaagtccctagctgatccatacacaaaattggaactgctacggtctttttcaataaatcatagatcatattcaacgaccccatatcaattaggattaccagtcctttgactgttccgttttctcgtacatactcttctacctttgtagagatgtcatgaatggaggcctcgattggcatatcaaagctggtaaatattgactctcctagcatgcgattacacacattggcgatactgctagcggttgcgaaaccatgagcaatgatcaatccatcaatgtctttgctctttcttgtataacgtagtgtcgaaaagaataatgagaagagattaatgtctaatgaatcgaactgaatatctaaacgtcgctcaatttcaggaaaaattttctttagcgtttgccgttctttcccataatgctgctcaatgtaggcttccagcaaaaattcagaaggctgagaaacgaaagacgttctcaaaatatacttgtaaatgtagtgagacacaaatagaacgaagcttccatcataatgaaagaacgcctgatattcgatttcccgaaataattcttgcatcgtttgatgcacaaactcttccaaagcaactggtttttgctttgaatccgtaaagactaaccgatccataaagccaaccacttgttgatcgatcaacgtacgcatctccgcatcctcatcattttttctcaacgaataaatttgatttaatcgatgaataaacgcataaaggtcttgccggccatcattttcggaaagagattgtttttccccgtcgaaaacgtaattagttgactcagaaaactggctaacgattttatttcgaggaagcgtatacatttgtgcaggcagatccttgatggaaacatggacttcatctgaagtaacattttgagaaatcgcactgccgcaaacatacttaatggcattttcaatttcaccaatatttcctgaataaatggtatgaagaaaaatattcattacctgcgagctgaccactattttcttttcaagccgtttgctttcaacttgaaagagcttctcgataatttcttttttttctaaaatactgcgttcgctcagattaggtaaatagatagtaataggaattcgacgcaaaaacgtctgtaaaaaagcggtggttttctcagttgtcgcgaaggccaatcggacagttgcttttcgctcggttgattcaccgatccgagaaaaggtccctttatccatgaaagtaaaaagtttctcctgtccttccgcattcaaccgatggacttcatctagaaatagtagaccaccattcgcatcttctaataacccgcgcttcttttcgtaggcaccagtgaaggctcctttggagtaaccaaacaataatcctgacaagagctctggattattataatattgtgcacaatttaatactttaaatggagctgtttctgatagaacttctgctttgaccatatattcatacatgatttgcacgaaataactttttccgatgcctgtatcccccattaccataacaggaagaccattatttggataaaatacagctgtcttcaattgttcaatgggttcagccaaacttttatcgtaaccgatcactttttcaaatacacgattgataggtactttctcgattttgtcacttaactcttttactgaattcaggacttcagatacttcgatagcgaacttttcttgataaccccctcgattgccaaacaagacgggccgtgtattgattttaaaaaaaatgccttgatcaacaaaacgattggccaatcgactcgcttgtgttcgactaaaggagagttgagcttcaatatcggctgttgtaaacagtcccgattcaaccgcttctttagtagcacgattcgctaattctcggctccatgtagtcacttctacttcaacattcatttctacacctctttctttgccctcgaaataacaaatgttaaaaaagagtataccacggaaaaatttcttttaaagacgaaattaaatctcacagagaatcgctttcatttatttgttatttcatggcctgtccaatgcctcatactttctgtttttattactaaacaactttgtcacaaaaaaacatcgaagctgctcaaaacgcgcttcgatgttctttagtaattttatttttacaatgaaccaagtttccatataaaaagctcattatcaacgaacgaataggattgtgttgttattcgaaaacttcttaatgatgtttgtagctggcatagtaaaagccggatacaaatagcgcacctccgatgatattcccaatatagacaggaataaaattcgcaaagaattccaaccatgtgccgtggccttcgaagatcgctgctggaatgacaaaacaatttgccacactatgctgaaacccgatggcaacaaaaatcatgactggaaaccatatcgtcaatactttcccagccgcatctttcgcaccataagacaaccataatgctaaaccgacaaaccagttacagccgataccagaaccaattgcttgtaaccaagacgcagctattttgtgatcagcaaggtgaatgatttggtctaaataaactcctgaacttgtcaatccaacaaagtgaccaaaaaaatacgccacaaaaatcgcaccgaccatattagctaaggtaatgatcagccagtttttcactagttgcagaaacgtgactttcttatccataaaagcaatcgctaccgccatcatattccctgtaattaattcaccgcccccaagcaggatgacaatcaatccgattggaaaaaccgctgctccaactagactggtgagacttgaaagtgattctggaatagaggcagagactctaacataggctaaatagccaagagaaatcatagcccctccgatgaatcctaaaataagtttcgcaatgatcggtttttgtacttttttggtgcctagatgaatactaatgtccataatttcttctggtgtgtgcataactctttgatccctacttttccaatagattttctgataaaaaacaatagtgatttccttcacatttccatcaacgattataacaccatcgtttttgattttgcattgttattgtaaaaaaattcactaaattttcatcagattctattaaaaaaaccccggttaaatcaacgtccgttgtttaccgaggaatccgtttgtttttgatctgggaaagcactctagaagcaaatccccttcttgagttgaatatcttagaattgaatgactaattcagctcttttattatttaaagtcctttcctttaaatgcgatggcatccacttgaaacaagatgcctacctcaccacggtgcgcaaaagaagtctgaatagactttctgacagggtattgtccattaaatttttctttgatgattttttccattatcggaatatcaaagatatctttgaaaagagcgtccatttggaccacgtctgctaacgtaagtcccgctagtttcaaccgttcttccaagtgatcgaaagcaccgattatttgttgttcgaccgattgtccgatatttccgacacaatagccaacaaagactaaattcccagcctcaatcactcctgaatttgcccaatctcggttaatgtcatagcgcttcatctaactcgcctcctgaaataatctatttgaatttttgtctgaaaaaacagcctctagtttcttactaaaatacataaaattgttctgctttattccaacgagatactcaacacctctctcactttttctgcacctttaattatcgcctaccacttagaaaatgaggcgacatgtttggtgttaaaaaagaaaggttgcgtcttgttcccttatcttcaacagtgaatcaacacagcgattcgaacacacgtggtccatattgctgctcgttcgatagctcttttcgctaatcgctttgatccttttagaaaataatctccaaccaggcgctggaaaagcatagttacgtctcagacttttactcccaccaatgattacttcagcaaggcaaacaaaaaagctagttgatccttctatcaactagcactagtggaaacagaccggcagccactactccccgagtcagaaacgaaaacagttaggtagcggttaatgtctttttgctcactagcccctcctttaagcagcctgcttacgaagatatatcgagaatttttctaaaagctgtcgactggatgatcttactaagaatggtataagtttgtcgatcgttctttctgagcaagtttaagatattcgttacttctgcgcgatcttctgctagaaaggctttaaaaaaagcaaagtagagctgcgtggtcagagagaaggtagaatcagtaagcgattccgtcaatttttcatctaagagtgatgccttctctaactcattatttgtaatcaagaattgaatcatattgacatacaatgcgccgattagtcgatcaatcaactctgggtaaagtgaccaccaagtgattgcggcagcaatcgcttttgagagtaatggctcaattcgttcttcctcatcaaaaaagataaaaaaagttgtaatgaacaattccagttccatcattgaaaaactctcaagacgtgtgaaatattctcttaaagtcactaaaggccagtgatcgatggtcggttttagtgaccaagccaaagcatatgctgcagagctgatcaaccgatctgagcttatctctgacgctttattgtccctatagatcactaataacttatcgacagaatgcagattgaagtcatagtaaatagcaatgacgtctctaatcgtgattcgtttagttgcaggattctccttatcataaaggaagaaaaattctggttcactcatattcatattttctaagatacgcttgaatttaaatgcttcgatcgcatactctcctgcttcaaatttcgcataaaagctgcgggaagctacacctgaataaacttctttttgagtgtagtgtttcgacattctgatttttttgatcaatgggccatacgccttcatctgaccactccttttcacgtatagtatactacacatttttaaatacgggggaacatttaccgatgatatagtaacggtaacaagtggaaaggtggtgttcagatgaatacagtactaagcttacaagcatttaaagaagattctgccgtttctccaaattcaatctttacgtttaaatgtcaaatctcactaaaagtaccagcaacaaaataaatgcgattaaaaaagaatagaatactcccccttggtcattctaatcttttttaattagatacaaagagatgtcaaagtcccccttgcttaggtttgatccttgtcgagcaaaaggggaataaagccagtttttcaaaaaaatgaaatcaatacgtcaagaaaagagggaatcaatggatttcatcaatacattccacttcatctatcctgatctaaaaaatacatatacagatcaagcatttacttatttaaacattaaccagaacgttcccaagcaaggatggaaaattcatgtttctgctacttatactaattattttttgatactgagcgaatgtatctcatgctgtatcgaaaatgatgtagatatgaaatttttgaagaatcttgatcagtttacaaacaacctttctaaaagtacccctagagcctattcaggaaagttcatcacaatctatccctcaactttagagaagtttattgtgatgtgcgaaaagttatatacccgattaaatgattttcagggaccttacgttctttcagacaagagatataaagattgtaaagtcctctactacaggtatggacgttgtcgagcggacgaaaatgaatcagagacagaaagaaagcaattaatttgtcccgatggctctattatcgaagacaaacggttgccttattattctcagccgccttttgtacaagatccttttcatgatagttcacaacaagagaacccatctgcattgctgaataatagatacaaagtagaaacagctgttcattactccaataccggcgatgtatatttaggaacggatactatcggcaatcgaaaggtgattattaaagaagcgcgcccctatatcgaatcctcttcatcaggtgattgtattgacatgcgcaagaaagaaatagccttctttaacctttttccgcagtattgcccaaaggtttatgacagtttttacgagtgggagcattattttacggtagtcgaatttattgaaggacccaccctctctgagttctcagatcgagtagttgaagaagtgtatttcgacgatcttactggcagctatcgccaggatgctcaaaagataatcatcgagttaatgaaaatgatagtagcgattcataaatttggaatcacgattcatgacatttccaatactaatattatgttacgagacggacagccagtaatcatagattttgaaggtggaaaatttgcttttgaacaatacgattacatcgtaaagactcctggttttgataatggggatcattcaatcgacagaatgaagcgagattatgtttccttagggctcctgattattaaccttttcatcggaacaaaccaactggcgcaattggatcagcaagcagcactggagacattttatctttttgcttgtcattatcagctagaccctcgttattattcactgatcagcaatttactattgagacctcattcgacgaaccttgaaatccagctccatcttatgtgcacccacccacttgaagccgtctcattagcgtataacgaaataaaagaaaatctattagctgatgatctttccaacgtggataagaatgcagttcatttgatcgactcaaaaagcagttcggttgatttaacagacttagcaaacgaaaaagaactattcattttggcttatctcagttatttaatggacaatcaaaaaataacttttacaaataacgtagatttctcttttgaaaaaataggacatgtaaataaaaccggttcggttgattatgctcacttgattattcttgttttggttatgagtccagcagaaacgatcaatcgattgaaacctatgattcacctctggatacaaaaattaatcggttctcagaatcaagatggcagctttatttcagaatttgatggggttgagggagaggggcttcttgatggtgcagcaatgatcgtctgttcattggtggaagcttatcgtttttttcgtgaggaaagaatactccagagtcttactgattggctgaactatacagaaaaatttggcaagacacatttcccgcaaatcagtaaaagaaatgcgaataaatcaccttatttggcaaatggtaaagccggtctgctactggcaaaatggtatgttttgcgaagtggatcagggacagaatccatgaaaaatgaaacctttgagcaaataaaagaactgccactggtttcttcaaatgtcagctttggatacggtattagtggtatcgcctatttgaaagttctgacaaataatctcaaaagaaacgattacaactctctattaacgaatctactatcctacaaggtcaatttcaaaggaaagaatcgatacccggactgcaccaattcaagaatagaagcgagatttctcacaggggaaatcggcgtcttattcttagtggattgtatccgacagagattggaggatcatcagtgaaaacactctataaacattataaaagcaatattcttaaaattttgttgctgtcaggcctcttatcctttttacgcgttctgccaagttatctactggcttttgccacgaatgctatctttgccagaaatatcagccaatttcttttttgggacctagtgattctcattctttggctgatttatgtctgctcaaactatttattttcagtttatcaggagaaagaactacaaaaaatcagtctttcattgcgaaaacgtgaagctgactctatcaagacagtcccattagcagacttcaataaaatcacggctgatggctatgtgtcgaagctgacaaatgatatcacacaaatcgaaacgcagggcgtgatgagtttatatcgtcttttttctaacggatggttgattttgttctcaattgttgcattggccctttttaacctttggctggtcgttttggtccttggtttaacgggattgatcctttatatccctaataaattcgggacagtccttgtggcgcttggacaaaagttatctactagtaattcctcttatacaaaaaggattgccaatatcttaaaaggttacaacgttttccgttacaataataggctggcagaaattccaaaaaagattaccgaatactctcaagacctttctgagaataaggttgccattgcaaaaacaaatcacaagattatgaacctcattgctttttctagtttattgagtcaagtagtcgtagatattgtgacaggctttctggcaattatcggacaaacgacgattggagctattagttccagtggcaatttagcagcaaacatctttaactctgtatcgttggtaggtcaatcggccatggaactaagatccatagagcccgtcatagaaacatttgttgttgataagccaatcgttcgcgccacgaaaaaaacctacaacgaattcactgattgtatacgaatcgaaaatttatctttcggctatgacgcaaatctcccgatcctagaaaatttcaatttagacataaaaaaaggggggaaatatctcctcacgggtgatagtggcagcggaaaaagtactttattaaaaatcttgattggtgatttggaaggctattcaggcgaaataaaggtggatggtcatcagttgatggatgtggatagccactcttttattcaatatatcgaccaagacaattatttgttcaacacttcttataaagaaaatgtcgctctttggaacaactacgcaaacacagaaatagccgaagcattgaataaagccgcggcagattttgtagatgatattgacaaagtagttgaaaacaacggtaccaatctttccggtggacaaaaacagcgcattggtttagccagagcctttattcaaaaaaaatcagtcatcctctttgatgaaggaacctcttcattagataaaaagaatacgttgctcattgagaatctccttttggaagacaacgagttgacggttgtgatgatcagtcatcatccactggaagaaaaccttcataaatttgatcaaattatttctatcagcgcccctttaacgcccgaatatcaacggatggccactgccgaaggttaacagttcatgaaccgtggagcaaaaaattctcattattataaatcttctgaaaaaaagtgcctcccaatttttggaggacacttttttggaagtcttttattcagattttaacagctgatgaaaagctgttcgcaactgctgcatcttctgtgtagcggatggttgatttgacgcattgacagaataataaattttaaactttggttctgtacctgaaggtctcagacagacccacgaaccatcagtaaatgtatattttaggacattggatgatggcaatgtaattctttcgattgattgaccggcaacccaccgttcagaagtcaggaaatcttctttgaccattaagacaaaatcccccaaatgagaaaatgacagggatcttaaacgatctagctgctgattcatttgcgacaatccatctttgccaggaaaaacttgggtttctaattgttcctcgtaataaccataacgttcatagatttcattcaagcgatcaactaaatcaattccgaaaaggaaacagtccagtgcggtctcaactaataatacagctgcttgaatcgcgtctttatccctgacaaatggggctaccaggtacccaaaactttcttcatagccaaaaagaaaggttttatcttttgtttcttctgataattggatttgttccccaataaatttaaatcctgttaacgtgtttctaacttcaatgccataagcttcggcaatttttgcccctaaatcagatgttacaatcgtttttgcgataaatgaatttgctgcttgttttactcgaaccaaataatcaagcaataacacccctatttgattgccatttagaaagactggctgtccgtccttacgtacaacagcacccaagcggtccgcgtctggatctgtggctagaattagctgtgttggctgtgtttgagcctctttcaatgctagagtaaacgcctgttggtcttctggattaggagaagagacagttgtaaaatcaggatcaggcagttcttgctctttcactgtccgaagattcgtaaatcccaagcgttgaaaggccttttgtatcaatacatttccagtaccatgaagtggggtataaaccattgaaagctgtgagccaaaatggcggatcctttcaggattttgggccacctgaatcaattgatctaaatacaacgcatctacttctttcccaaaaatatcaatcaactgttgctcgacataagttgacaataaatccgcttcgatcattaattcattttgaatacttgctaatattcccatcaattcttcggcagttcctagtgtaatttgaccgccgtccgaagcatacactttaaatccattgtattgcttaggattatgactcgcagtgatcatgacacctgcaaaggctttataataccgaactagaaaagacaattgcggggtcggacgtaattgatcagataaatagacccgaatcccctgactggctaatacgcgagcggtccattccgcaaatcgtttagaaccatgtcgattatcaaaagaaatcactaccccctgttgttccgcatgcgctttttgaacatagcgagctaatccaagtgctgcccgcttaatggtgtagtcattgattcggttgatgccaacacctagctctccccgcatcccccctgtcccaaaagccaaatagtcataaaagtgttcttctatcacagcaggatcagacagagcgagcagctgatctttcaagtttgcttccaaagatggataatctaaccattcttgatattttcgttgccaattcattttgtttcctcttttaattgtttgagaatctctgcaatcgacaaggtgcagccagccattgaagtatctgctacgccataatacatcgtcaattgatcgccaatttgtatgccaccacagccaaagacgacatcgccaaagaacccattcttttcatagtctgcttcaggttccatgattggtttttgacttctagcaaggactctcgttgggtcttgcaaatctactaaggctgcacccatacaatagcgatgttcaggagtcgcaccatgataaataatcaaccagccttcgctggttttaataggaaccaacccgccacctacacgcccactgtcccaacaatcttcacgaatccctagtaaatgccggtgctgtccccagctaactaaatctggcgaagaagcaatccaaatgtcatagttgccaatgcttttcagagagggacggtgtaaggcgtaataacgcccattgatttgttctggaaaaatcagcacatctttgttctctggtgcaaagatattccctaaatcttgataggattgaaaatccttggtagctactaatgaatcacaaacacccattggtgagacagaactaaagttgatatagtaaatatcgccaatctgtgtgcatcgcgcgtcttcgatgccatatgattgatattcattgaaaggatacaagaatgcctcctcatcaatcgtaaaatgatgcccatctttactgcgggcaattcgaatataagaaagagatgtcagatagacaaaactatccaacttgtcttttttgcggatcattctcggatcgtcaaaatcataatctggatcatctcggtggaatgttaatacttccatcgtttgtgttcttggatcaaatacaggcgctttaataacgttaaggtcgtcagagattgggcgctctgccacacgtaataaaagtaagacttcatcgttgtattttgctactccaccattaaaggcgccaatcacttcatacccttcatgtaatggtttcacatctgcgggagtgatcaatggattttcattaaaacgttctattttcatctgcttaacctctatctaaatggattttctagtttgattttctgcgcgcctgcatcactgatgccggcatatagtacaatatgatctttatatatatgaataccaccgctaaagacgacatcttctaaatctgggcgtttcattggtccttgttggaaatcgtttctttctgcaataatttttgcctgtgtcatagcaaattgatttcgttccagacagaaaaccatcgcataataatgacgatttccttgatcatcgaaattctcgatatggcctaagacccaaatgtcgccatcaatctcatggatctcattgccgccaccccattcgctttcacagaactggtcagacagtaacggggcttctgtaattgtttcaatggtcaaatcactaagagtatgaacgatcgttgcacctatcttgcctcggccacctttagttccttgcggtcgtgtcagcactaggatttctccagaagataattgtttcaagcgcaagtctttcatcccccacggcccctcaaagattttctttgcttcggaaagagtcgccaagtgataaaaaaccgtacgccaattcgctgtgccatcttctagaaaaacaacttcaacccccccaaggatgacttgtccgtcaattcgagtataaaaaggatcctgtaaagaaagttcgatactatcagcgattagtgtccacctgtttgattcaacctcttcaaataaactgacagtggaaacttcactgtctcttgattcaatgcgacctgcaatcacttctttccccgccaattcaaaaggggcagtgatattataaacatcttgatcacccacaccgctaaatcgcaaaattgcggcttttttgactactttggctttctcatttcgatattcctgcaataattgcttgatataaatcatagctgctcctttccaatccaacatgcctttgccggcagatgaacccagtgaccatcttcacttaacatgccatttccaaaaatggtctttcgatttccttctaacgagtgcttgatcggctgtccaaaatttaaaataatttgtaggctttccgtttgataactcaagcaatctcctgttaactcaatgttgcggatggctgtaaaaggtccttctgtttttcgcaaccgaatcagtttttgataatctgccaaaatccccttcgcctcctggttcaccgctgccaatccgatccaaccgctttgctgatttgatagccaaggaagcatgcccctcgagcggtcacgattcacttggttggccattattaaagcgtgtgactttcctcttaaaatcagttcttcttggtatttattttttgcttgaatatccctgatatcagctagctgctgaggcaaatagtcaccgacaccttgttcttctccctgaaataaaaagggaatgccacgattgatcaacagaaacacggtcaataagcgatagatgtcgcggttttcatttgcaagccgctgccatgaacggctcatatcatggctgttaaagaacagcgtaggcattttcttttgttgactcatttctttaaaatccctagctagtttctcaagatccaatgcttccatgctgcccaaattaaaatgaaatgcggtatcgaacaatccatcttctgtataactgttgatcaatgagagttgatccgagctaatttcagccactgtaaaaattgatggatcgactgctttgatccactgatttaattcctttaacacacgtttgatccccggttgattcacatcattgcgatgatcttgtttcccatcttttcccactggattatcaataaattgatcactgaccgtcaaattattgatgacatcaaaacggaacccatcgacacctctgtctagccaaaattgcaagacatcaaaaacggcttgtctcacttcttgattctgccagttcaagtctgcttgctcttcggcaaagctatggtaataatattgatccgtagccgcgtcatacttccaagcagaaccacaaaaaaaactttcccagttgtttggttgatcttgccatatataccagtcccgctttggatgttctttgccactggctgattcgatgaaccaaggatgttcggtagaagtatgattaactacgacatcaatgataattctcatttctagctgatgggcttcttccacaaggagatcaaaagcggctaaagtaccatactgaggatcaaccccacaataatcggagacatcatatccattgtcaactttaggcgaaggataaaatggtgttagccagagggcatccataccggattcttttaaatagggcaatttttcacgaatcccattgatatcgcctattccatctccgtcactatctgcaaatgaggcaatataaatttcataaaatacagcattttcccaccacattcgttggtctccttacttcagtgtaaattgcattccatcttggaatcgttttgaaaaaatcaaaaacaaaaggatcaatggtaacgtgagcaacacagaggctgcatacattggtcccggatatgtcccataaggcccaaacatttgcgaaatcaagacatttagcgtaacagtggcgtcactctttgaaacgatcatatcccaaagcaggttcgtccaacgatccgtgaataggaaaagaaaaatcaccgttgtgatcgacttagacattggcaataccactttgaataacacttgcatttccgttgccccatccaactttgcagcctcgatcaacgcatcgggaatggctttgaaaaagttggtatacataaaaatcgcccataaactaattgcagtcggaatgatcattccagcataagaatccaataatcccactttggtcaccattagaaattgggggatcagcaaaatgatcgctgggaaaaacatttgaaagagaataaaatgattcacgaatttcttccctttaaattcgattttggcaagcgcataccctaccatcaatgcaaagaccatcattaaaaacgttgcgatcgtagccacgatcgtggtattcacgaatgcaccgatccaaggaacatctgctgaagtggccgaaccgccaaacagccacgtccaagaacgtaagctaaaagtggtcgggataatttttcgatcgacttgatcccaagcagcaaacgagtgcaaaacaagatagacaaaaggaaacgtcatgaggagcatcaccagggtggttactagatataggacactgttctttcccttcgttcgtttattgccaaccatttttttcaccccacttttctagtaacttccgaataacgccgatagatgcaaaagtaacgacagaagccattagtgcaactgcagacgcgtagccggatttcaaattaacaaaggcttgattgtagatttccatttgccatgtattggtcgcaaagtttggtccgcctcctgtcaactggtagacctctgtgaagataccaaagctgatccccaccgccagaactgtaaccgtaaagaatgctgggtacaacatgggaaaggtgaatttccaaaaccttgtccaaggactcgcaccatcgattgccgctgcttcatacacttctttgttgatattccctaagcccgaaattaggatcagcgcatagtagccagacatcttccaagcgatcatcagagaaacgatgatgatggctgcatggggattacctagccaatcaatatcccagcctagtctcgttcgcaagaaggtattaaagggaccgttgtaggaaagcaatcctttgacgatcaaagaagtgacaaccccgcttgacaggtaaggcaagaagaaagccaccatgtataaccccttcagctttggcaggctgttgactaatagcgcaatcaccatcgaaagaaccagcgccattggtacaaagataatcagaaatttatatgtaacgacgaatgcagattggatcgctggactttttatcgcatcaataaaattctgaaatccaacaaattcaacggtcggtgaaatcatattccaactcgttaatgctagccaaaatgaccaaaataaaggaagtagaaagaaaatcaatgtaaaaatcagataggggctggtaaatgaccagcccaattttgtgttcttactcattattgtagcgccccttcgacagctgtcttcgcatcgctcacagctgttttcgcatctttttcaccccgaacaactggcacccatgcttgttcgccaaatacttgctgaatgtcattgtatttctcgttgtccattgctggaaccgcatacggtacattctctgcgtagactttcatcgctggattttcttcaaagtaggctttgaaagcatcgttttctgttgcatcatcgcgcgctggaataagcgaagtcatttctagtaatttcatgtcgttgttttcatcagaataaacaaattccaagaatttcatcgctgccgcttgttcttcttctgttgcttgggcgtacatcacgattcctttagcatctgcataggtggatacttgttctgcatccgctaaagcatcaggtaccacaggcgtagtaaccgtgtagttttcaccaaacttcagctctgggtatttttcttcccagttagggaacgtccaaggacccaaatcggtcataatactatcgccgttttcaaagggatccgttgcttcaccggtgcgcagtacttttgcatccgctaatgtatgcatcaaaccaaatacatctgtcatggctgcttcattagctgtgaattgattgttttcgacaaagctcgcaccttcactggccgcattgtagagtgggaagaaatcaaaccaacgcatccaagccgttggatctgctaagtcttttttcgcccaaagtgctttgtccgttcctttgattttgtcgacgactttcaataaatctgaataggttcttggcacttcatcaaagcctaattctttcaaactatctaatcgccagccaaacaaaatcggattggaataaacaggtagcacgtattgactaccatcagagaatttccaactatcgatggtttgactcatattacgagctttgacgatcgtatcgaaagaatcttgtttttctaatggtaaaatagcctgactagcagccaactgggcagcaaaactacgattgatgttttcagataatgttggtgcggtgttagaagcaatcgcactttggattgttgcttcagaagatggactttccttcatttgagaaacttcaactgtaatgtcttcattttgtttctcaaagtctgcggccatttcttgccaatacttcaattgtgttggattgggtgcagcccaaaaagtaatctttgtcttcccatccgttgccccagaaccgctctcttttgattgattgctacaaccagtgaataaaactgtcactgccactaccgcagcaataccaaaaagcatttttttcattttcatgatcgttcctcctaaatagtaagcgatttctttttacaccgtcatcataccacccgtcattttaattgtcaacattacgtaattataattacaacattacttttgtaattgttttaggctattaattttgtaacattatggtataatcaatataagactaggagaaataaggtgaaaatatgaaaaaagcctctatgcaagatattgccgatgcattgggcatctcaaaaaattctgtctcacaggcgttgagaaataagcctggtgtcagtcaacaaaccaaattactcgttaaaaacaaagcagatgaattaggctatcgttatcaaacgatgaatgaagataccacgatgtcattcttattgatggcaaccgaatttgctttttctcaaacgagtttttttggcgaaatcgttaaaagtgcagaagtagaagctcaaaaaacagcgatcaaacttgatacttataccattacagaggaagacttacttagcctaaagcttccgccaaacttaaaaaagtatgacggtatcctgatcctgtctcatagtaaaaatgcctacatcaagaaagtaattgatactgggcttcctgtcacattgatcgatcaccatgatccttcactcacagcagatgccatcttgacaaaaaacaccgacggaacgttccaagccatctcacttctgattgaaaatggaatgaagcgaattggctttattggtgatacagcattttctcccagctatcttgagcgttatcgcgggtatcaacgggctttacgagaacacaatctaacacatgatcctacgattgaaatcacagaaattgaagaatctcaaggtgctttatttaacagcttaaagaatataaaacaaatgccagatgcatggttttgcgtgaattctgggctagctttcatgttaaacagttatcttcaatcttctggttacacgatccccaaagatatcagtgtgatttgttttgatgaaactgaatttacacgcatggcgattcctcaattgacaaatatcgctaccgatctgcagtttatgggccagttggcgattcgaacattggtccatcgaatcgcccatccccaagagccaatcgtccatcagcaaatcgttccgcagctgaacatccgagaatctgttcgacttattaaagcaaattaaaacaaagcgctaaattctcccacaaggtagaatttagcgctttgtttttgttgaatctattgtactggttacttccccctaagcgaagcaggcgaatctccaagagaaacgagagtcattggatcaagcagcaaaccagaaaagaaggcgaattaattcttgattgctttaagagatttccctctaattttccaaaaagaataacctgcaatcacgacggcaattccggcaaggatccacggaccggtgcttcctcctgtgactgtgatggtttgttcccctagattggcgttgctataagtgatcgtttgactgctggttgcttctgcttccgcatctgtcaaaaaaatggcattgctgtattgctttgaaccggcttttttgatgattccgccataattgatctctttgactttaggatatgcttcgataaatcgccgcgtctcatgggtattcccaaaaatgatcatgatgttttcggcgagttgttcgatcttaggcattttagcaattagttgatccgttgctaaaatcgtcagcttgatacccgccggtttggaaagattcaacgacatcttcttgaattcatcattggcagcttcatcgtttgcgacaataatgcggttgatattaaaaaacttactccaagaaaaaacaacctgaccatgtaacaaacgatggtcgatccgtactaatttgatcataattcatcctcctctgctgttgcttcgactagtaatttcttgcaatttacaatagattgctgactttcctgaataatagctgctaattcttcttgcgagactcggttgacttgtgtcgcaagcgtgatcaccaatggaagattcattccagcgatcagttccaaatcggggtgctcttgaacgaccctcagcaggtcgttgttgacactccctccaagaatatctgtaagaatatacgtgtctgccaagtctactttggctaatatattctgaatttgctctgtcatcggttgatcttcgtctcgaaaagcagataatgcataaatgttcgaatgatctcctataatcattgcagcagtctgttttaatccttgagataactctccatagcttgctagaatgattgttgccatatcattaaccctcctgtctgtttacacctttctataagcaaaaggcgtgccaacttcataaatcgctgtcatagcaaggattctatcagcattcaacactgggaaaaagcgtgctgagagagtgttgggggggagtgttggagggcagtattggagagaacattagaaggaagtcttagtttattgcaactcttggtgtaacgacttgctgccaaaccaaccgctgataaactgataaaccaaaaaagcgtctagacaagcaaatcattgcctaggcgcttttcttaaaagataaatgttgtatcactgtccatcaaacagaacacttctttacgggtatatgcttgcggtttgctgcatgataatcactgaaaactttcttcgatctcatttagatgaaaacaagcaacttccgccgccccttgttggatcaatcggggtttttgcatgtggcatttttctgtcgcgtagatgcagcgaggatgaaaaatgcagccagttggtaattgcttgatgtcaggaatatccatacctttcaaaggcaaatctgggacagtgtattgccggttagcgactccttgcgggacggctgctactaatgcccgaaaatatggatgattcggatgattggtggcttgtcgaatatcaccgacttccatcacttctcctaaatacatgactaagagtttcccatgatctgaaatataacgggcagtggcaagatcgtgcgtaatataaacaaaagaaattccatacttctgattcattctccgcaacaacttcaacaaggagatccttagagacacgtctaccattgaaacaggttcatctgccacgatcaattctggttctacagataatgcccgtgcaatcagtacacgttgccgttgtccgccgcttaactgatgcgggtatttatcaatgaactgttctgtaggaaataacccgacatcggctaatagcccatgcactttccttcgcgcttcattctgatccttagcgaatccatgctttcgcatcgctgcttgcagtgaatggaaaatcgttttgtaagggttgagtgccgcaaaggaatcttgctggatcatttgcactttgaggcgatacgcctgatattctttctttgtcatcgtgcgcaagtcttgacctttataaagtacctttcccgctgtaggttgatggagatccgtgatcagctttcctaatgtcgtcttgccacagccgctttctcctactaatgccaagctttctcctggagcaagcgacaaatcgattcctcggagaatcgctggctcatttggcgaaaaagctttgtggacagctactaattcaagtaatggactcatggtcttcctcctgtacctgtttgaagtggatacatcgcgcagcttgttgtttactgacaggaaaaagcatatggcaagtctcctcgctgccatcacaagcaatgcgcacagcgaaagggcatcgttctttaaagcggcaggtcgcgtccgctttagctaaatcaaaagccactccttgaatcgatgaacgtgtatcaatagcatccgtcaagctaggaattgccgccaataacgctttggtatatgggtgggcaggatgcgtcatgacggcactcacctcgcctacttctaccagttgtccagcatacatcacagcaatacggtctaccattgaactaacaattgatagatcatgggtaagaaaaacaatcgtaattcctttctcttgattgattttccgcaaaatagccagaatatgccattgagtaatcacgtccaacgctgtcgtaggttcatcaagaataatcacctgcgggtcaagcagcaaacttaatgcaatcagcactcgctgcttcatcccgccgcttaattcaaagggatacatttttctgactccttgatctaatcgcacatattgcagcaaatcattgattttggcatccagtagagcatcgcccgttttttgatgggctactgctgtttcatagaaatgttcctctactgttaagatcggattcaacgcactttgtgccgcctggaaaaccgttgcgatctcccgccagcggtaacgattcccttcctgtgaaggcaaggaaagaaagtcaactgcctccccagattgccaataatatacttgtccagccagtatttctcctggctcatcaatcaagtttaaaaggccaaaagccaatgtggactttccgctgccgctctcaccaatgattcccagaatctctcctttttcaatcgttaacgatactcgatccactgcattgatcgttccacgatccatctgcttcaaaagcatctctgaagcttctgatccccctcgttctccatgcgcgtttgaacctgctggctttagttgattctttcgtgacggcttgtcaggattccgactgattcgccattttgatctacttttcgaagttgcgtgacgacgaaaccctatagttagctggtctgcttcaagtatcttacccatcgatctcactcctaatccttggattaaaggcatcttctaatccttttgaaaaaagaaagcaggccgactggaaaacaacgatgccaacaatcggtgtaatcaaataaatagcagctgaggatccaaacatggcaccggttttggtcattgccaaattcagcatgattccccaatgctcccctttaaaaggtgccaatccaagcaacatcaagccgacagaagcaagaaccgatgcccgcatgatcaagacaaaattgattgcaatataagggatcagactaggtaaaatatcttgccgaatcatatatcccttagacattcccaaaagccggctagccagaatgtactcacttccccgcaatgtcatgacctgactccgaacgctgcgagctaaccctgcccagttccaaatcgccaaaagaaaaccaaaagccagaacatttcctgcactgatcaccaaagaaagtgccataagtacgggaaaagaaggaatcgtcaaaacaacattcgtgaggaacatcaagagtttatctgttgctcctcccacaaatcccgcaacaatgccaatcgacatcccaatcaaaatcgagaaaaaacctgaaaataaggcaattaggacgacatccctcgttcctaaaataaactgcagcaatgtatctctaccagtaaaatcggttcctaaaggatgttgcaaagaaggacctaataatcgattggtataatctgcgggcaagtcgccaatcagccattgcccaaaaagagcgaaaccaactaaaatcagtaataaatacattccaacagccgcttgacgatttgcacgaatcactttgataaaagaagacaattgtttcattctgtctgcctccttaatcgaggatccaaatagccatatagtgtatctacaatgacattggcaccaactactgtgacaatgatcataaagaacatcccttgcatcaaaggaatatcacgcaccgcaatagctgtgttcaagtaatagcccaatcctggataagaaaagatgttctcaatcaaaggcgcaccgcccaataaaagaccaaaagtcgttcctaatgtagtaatcatgggtaagcgagcattctttccgacatatttcttgcggatcacaccatcactcaacccacgcgcacgtgcatacttgatgtattcttggtgcataacattcatagcacttccccgcatattcagaatccagttcgccaaataaacaacaaaaatggcgctgataggcaatatcccatgacgtgccacactaatgagaaacggaaggttcaaaccaaccatcacttgtgatccataggcaccgcggcttggcagccagacaagctgcacggcaaacaaagagaccaagaagaaaccaatgaggtaatccggaaacgagccaaccatggaggtcagtgtttctgtcaccgtatttaagcgtttatttttgcaccatgcaaccatcaaaccgattcgtgtacccgccatgtaagaaagaatagtcgccacgccagctgaaaaaagcgtccaaggcaatgcacttaaaacaatggataaaacaggcgtccgaaaacgaatcgaagtgcctagatctccttttaagagctgcagaatgaaatggccgatctgctgcagcaatggctgagatggatcataattcagcatactgatcgctcggctcatagcatccgcttctgagattccttgcgtacttcgcagctcatttgccaaaatcgttactggatcgccaggcatgattttgataatcaaaaaagtcataaagacgcctgcggttatcgtaaagaaaacattcgctaatttcttcatttcttatacacgcctccttccagtctatttgtttaatcagtgattcccatgctcttttgcaacgttccttccgcaatcaatgaagaaaacatcgattcgccgacgccaataaagcgtgggtcttgaaccaattggtttgcaggaacttgaaagtcaatagccggattaagaacccgcactggaaagcctttttctagataagggatgaacaagatatgctcatttgtcactgccatcaactctttagtggccgcaataaaatcgtctccctcactgtcaaacagatgattcgttaaagcgatcacatcaactttcccttgagcgttggtcaaatataattctcctgttggctccgtttcaagtccgaatagccaactgcggcccttatataattgttcatacgtcccataaggattggcataaagaatattagaaggcggggcaaattcgatagcaacggtgtgctctccatttctcaaatacgcatcataagaagcgccttccattggcagaaatgtcacatcaaagccaaaactattcaattcattaacgatcgcttctcccggcaataaagctgaaccccagccattattgcaagcaaaatcaaaggccactttatttccttgcgcatcgatccaggtatcttcttttgtccaaccagctgctaataagacggcttccgcttgctcaacattgtattctcgtgcggtgagctccgactgcacccaatctgtcaatccataaacttcttgtaaggaaagcggcaatcctgtactccccgtctcacttggcatactgccgacttctgctaacggaagaatttcatcaggattcaccaaataggccacagcttcgcggaaagccagctcctgggcaaaagcctgctttacattgaaaactacggacatttgtgaatactctggtaaataaaattcagtaaaatggtccaacttactttcaacttggcgaatcaaatcttctgtcataccgccactgtgcatatcgagagtcccatcgatcatactgttggcagctacttcaggtgtgacagcgcgaataatcgttaatgaatcgatgccagtctcttgataaaaatgttcattcttctccaagactgcttcactggtagaaagagcagcaatcgtaaatgcgcccgaaccaaccatatctgtcacttgcggcatatatccttccaattcttcattaaggatttgtaattgttcatttcctgcttctgaataccaatacgtattggtctcatcatgccattcccgctctgcatcagcgatgccttgatattgctgtgcccaatcaccgtattcctcgaaacgagcagctacctttacatcagtcagtagattcagcatcaagtgactttcatttttgaaataaaacgccactgtttgctcatccgggacttcaattttctctaaaaattcccaaatctgtttcttaccgacccacatttggtagctggtgaggacatcttgagcagtgatgtcgctgccatcactccatttgataccttccttcagtgtgatattgatcacattttgatcaatgctgtaactcgaagctagcctaggcttgaaattctcgccgccttcacctactggggtgaatgaaaacaacgcttcttgcacataaggttcaatcccaccaccaataaaaccactaatatagggattgccatgggcagttggcggaacaacataatcgccattgatcactaatgtttgagagtcctgcgctgtttgatcggtctcctttgtttcttctccacaggccgttaagagaaagaatgcacccaagcaaaccagccctttgaattttttcatgtgttcactcctcagctaatatgatccctgttgatccgataacgattgacggattgtctccaatgactatcggatcaaccataggtgaatagaaaccaaggcttgccaacttctggacctaggatagaaggattgttcacccgacgaatgtaacgacttactattcgttcagctatgactacctatttatcagtaagcattatcattacgaggcttttatgcctgccatttgtcaaaaaacgattctgcgcatgaatgtttagacaacaaaaaaaggcatcggacaagactgtccaatgcctttgacatagcaaaataagcgtctagcatcccgcgaaaatttaccaaaaaaacaccccgctactagaaatgaagggaaattttgggtacaataaacacgttgatgccgatggcgttcaactatggcaacttgattggtcatcttggttaaaggtctgactgatcagggcctcgccgctctgcgccaacagagttgcgaggtgcctatttttttggtttctattcggttataagtgtagccgattttggaaggggttgcaagcgaacatcagaggaaaaacgaacaaaacattcaaaatatggcagtattttattgagatatggagattatccttgatatttctattgttttaacaagaatcaaacggatgtacaggacttgctgctcttcttttaagaacacataccacagggcagttactggtctttgttttgttccttctttcgcagtgcttcgtctaataagtaaatcacagtcaaatatttatccttctctttattaaaaggaatacgcaagtaatacccagcaatgagaaccaacaacaaaaacacaggtaatgtgaattctggactttttatttcgaatgtcaaagccaacatagctaagataatcgataacgcagacatcgagtaagacattttgtcatatgatgtaagcagctctttttctgtattagaaaaacgtgtgctccaaaatcgcaaaataaacgcatcttcttccgcaaccctatcaatcagttctactaattctgcttttgtgcgcacttgttttacatgcgtgtataagatatctttcaccacgccgctttgatccttttttgtatagaaatcaaataaaatttctgataaacaatactgagcattgttctttggtctaaacttctttaacatctacttcctcctttggtattataatcgcagcacatcataaatatttaatatcaaactatataattttatcaaaaagttaaactaatttttcattgtctgcaactctatttcattggatttaccgacctaaataatactatgaaaatgttactcctagtatgactctctacacaaaaagagaccaagaatccttccgattctggtctcttacgtcaaaactaatactcacaactcccggtatttctttttggagtccttactttgttccaccggatatttcaccgcatttttctgcagtttctctttgatgatctcatcaacatccagctttagattatccgccagcatataaatgttttcattcctacacttcctccccaacaagcgtcaagaaagcctcttcgagattcttcttattcacttttaatagaatatcagctaccgtcccgctggcaacttctttgcctttgtttaacacgagaatccgatcacacagcgtttccacttcatccatgtaatgagaggtcagaaagatagtgacccccttgtctttcaaagcgagcaagtatcgccaaacctcgcgcctggcctgggggtccagtccggttgtcaattcatccaaaaaaatgatttgcggattccccatgatagccaaaaggatacatagcttctgtttctcgccccccgataatgttccgagaaatgaattcaatttagaggcaagaccaaattcatggagcgcctgcatccagtttagcgggttttcgtacaacgaatgggtgatctcgcaaatctctcttacctttaattgattttgaaaggcagattcttggaattggacccctacatactgaaacagtcgtttccgttcagccttaggatctcttcccaaaagcgagatccttgccgaatcacatttttgtgtgcccaaaatacaatcgatcgtcgtggatttccctgccccgttatgtcctaacaaaccaaagatggtgcccctttcgactgtgaaactaagatcatcaatcactcgtttctccccaaatgttttgctcaatccatgaacctgtatcgctgcttgtttgctcatacattccctcccatctgatctggactcagtttagccgaaaatcaaacaatgatgggatagtggagggaatagaaatttttttctaaacaagtttgcaaattcctaaacatgttcagaacaaagggaaaacacttacatttcaaaagagattctttatactagtttttgaagaaacagtggccacatcgttcttctattcaaaaatagccttcagtgctgcacttagcaaaagctcaaattggttcagtgttgtgccaaagaaaagattcggttggtaatcggagattctttggggagtatatgtttctgtgctaatggtcagtgtggctaggctgccgatttttgaatttttttgaccaacaaaagcaatcacatcgatatggtggtcgttagccattttcgctagctcagctaaccgaactgtatccccagaattagaaataataacgagcagaatatcttgctgcacttgctgtctaagaaattccagatggctattggcagttgcacgaaagccatataaattaagagattccgaaaaataattggcgagattctgagagaaaccggagccaaggatcatgatgcgcttgtcgcgatactcagagagtaaatcgataaatgccgccttttcctcattggagaaagtgcttggcatcgcaatgtccgattggctgttacctagtgcaaaaaccaactcgctataaccggaatagccaattttcttggccatattgatgattgttgctgtagagacataggttgctttagccacatcacgaatcccgattgtttttaatgactgccgattttttttcataaaacgcaagacttctgcttctgaatcattcagttggtatttatctataagcatttcaacatccataagatccacctcaaattttatcaattaggagtattatatcatgacagaaacgaaatttattcaagatccctgggcaaaaatgacgacccgcaacggtttacgcggagatgaagttatctcggcattgcaaaagtcgatccgtcgaggcaaagaaaaagaagcatgtgaatttgcctatgaaatgtatatcacctcgccgcaatttgaagaaaaactctggagaagattactagcgatcagtgttgaagatgtaggtatgggaaatccaatggctgccattatgatcaataacttaaacacgatgcgcaaggaattccaatacaacgaatccgatcgggcaatgtatttcttccatgcgattcgttacttatgtcagtcggaaaaagaccgctcatcagacttactcaagaatattgtgatcaagagtttcgcgatgggctatgttccagaaattcctgatattgccttggataaacatactgtccgcgggcaggaaatgggtcgtggttccgaacacttcttacatgaagccagcaaagtaatcccacaagcaaaagtcactaatgactacaaagaacaatacgaaaaaatcatcgagaactatgatccagatcacgttgtgccaagcgcgttttcattcaatccttggcaagtataggaggaagttacatggaaaactctgcatttatcatgaagctgaatgacgtcctaagccccatcgcagcaaaaatcggcaatcagcgccacttaaaagctatatccagcggtatgatgtttggactaccctttattgttatcggttctttttttctaatctttgccaacccacccatcaacatggatcagtaccatcctgaaacagccaatatctttatgacatttatggctggctggaaagatttcgctgtagcaaattatgatctcatcaccgcgccttatcaattgacgatgggcatcattggttttatcagcgtctttgggattgccttctctcttgcaaatgaatacaaaatcaacccttccatgaatggtatggttgcatccgtcatttttctaatggtttgtacaccagtgaaagaaggcgcgatcagcctcaattttctaggaacgaacggactcttcgtcgcaatcatcatcggcttgttagtggtagaaatcaatcgtttgtttgaagtgaaacagatcaaattgaaactgccaggtaccgttccacccatggtggcaaccttcatcaatatgctcgttccgctgttgacaaatatcatcatcttctatgggatcaatttgatcttcttggcagcaacaaacaaaatctttcctgaagcagtgatggaagttctgactcctgcaacgaacatcgctggcagtctcggcggtttcttgttgatcgtgactttgggcaatatcttatggctgtttggcatcaacggttcttcaatcatctttcccatcgtctttacactgggaatggctcaaactggcttgaatgccgagcaaatggcaaatggcgaaaccatgacacacttaatgaacttacaaatgtttcggatttcagtccttggcggagctggtggtactttgggattggttttattgatgatgcgaagcaaagttcccgaatatcgcaccatcggaaaattgtccttgattcctggaatctgctccatcaacgaaccagtgatctttggcttgccaatcgtttttaatcccattctagcaatcccatttttggtcactccgatcatttcgttattgctgacctactttgctcagagtcttggatggatcggtattggctttatcgttgatccttccttcacaccgttttttgcacaagcttatctttcaagtatggactggcgcaacattctcttttgcctactgttgatcgtcatcagtatcttcatatactatccattctttaaagtaatggagaacaataagacaaaattagtcgatcaaaatctataaccattcttcgtaacaaaaactagaacagctaaatgattttgctttatactaaaaaaaagacaaatcctttcccattcatcgaatcaactcgattcgaatcagaaaaggatttgtcttttttggttaaaactccttcatttaaaagacctgaaaagtcagcacaggtttaggcataatgaaagatttcaaagcggaggccttctggcgtctcaaagaatagtgcataatacttaggcgcgatccgttctttgtattccattggtttcccatgaagaatctttactcctagtgctttgatttttggatagatcgcgtctacggcttccctgctttctgctttaaaagcaatgtgttggagggaaccaggctttctagaatcaattgtctcattgatccattcttgctttggcgaacagatcccaaaatcaaaggtatcactcaaatactctactacttccatgtcggcatgttcgagatagcctgaatatttcttttgaacatcaaaacctaacaaatggaacaattgatcataaaagggttccgctttttttcatcgttgacagtaatttgaatgtggtggatttgatacatcagtggctctcctttcgttataaaccaaaacagttaacagttctcgatagcaaagggtgggtactgaatcgctcttgtcgccaagtgaatgagtttttcctgattgtcgtcagccgcaattcgattcgtctttagagtaccacaatttcggcaacggtgaatgattgcccattcgccatcctccttggaccaaatactgataggatccatcttccctcggcacaaagaagctcggtctccgggaagagtatccgcatgaagactcgttaaacagtggggacagtggttgcgatgctgactacctgcattttcaggatttaccggtcgaccgcattcttcacagataaaactgtcaaaacaattgaaagtaactctaacaatttttaaattgttctatcagtttccttgaaggtggtttacgatcaattttctacatacttagtttatttagtataagaaagtttaaactttacatatatttttcttgtataaggattagttcttcttgtctatgataaaatttattaaacagtttgaaagtaaaaactattcaaagaaagtgggcgataacaatgggattttggtattttttaacgttagctgtcggtataactttgttgatcataagtgtttcaaataaagaagtatctagatcaaccaaattcgtagtagcctgttttgttttagggatcttgttagtcataggtagtctacttttatttttaccaggcagctcttcgattattgagcaactacttcaactaaattagcttcgttattaaaagccgactttctaaaaaaagaaaatcggtttttatttgtactggtcgaaaaaaatttttctacggctggttttgactttattttagatccagctgaacgatcaacggctccccttcttgcattgcttcatccaacattaaagaataaacatcggcatcctctttcgtgatacgtaactgttgcgcactcatttcgccagcacccacttcttgaatacgcatcatttggttctctggatccacgctaagtcctccattctttggtttggcgaattagcggtaaaaaaacgtatctggggtttgaagttaggattcaaaaaaatataagaaaagccccatttaaggggctttccatttaaggggcttttttatctataaaataaagttcagaaaagtctctatcgtgccactttcatacatgatgtatagtccaagtggaatgaatactaagggcacaatgattcgctcgtatttttcaattgtctcggatattaacggaatagaggatagcacccgactaagctcgcaaaagataattatgccgattgcaaacacaagcaacgccacgagggtctgtgaccaatctaacgaagcaaaataaggtatatagatacctaaattatctccgccagacgcaattgtcagcaatgtaactgtccaaaacagttgatttgccttgctttgttctaatctttcaataatttcttcctcttcttcttcctcaccttctccaacaattgcaaagcgaatccctaaatagatagggattaaaccaagcaatccaaccatccatgcttcaggcacgaaattgacgacataagcagcaactaaactcgcccctacaagtaagcctgtgcctagatattgccccgcataaatatgccatttctgtttattctgtgatagctgtgcaaataaaataatcaatataattaaataatcgatactggtggaaatataaacaccgatagcagatatgattgtctgtcccataaaaaaacctcctgtattagtcagtaataaatcagcagattttaggggagcacagacacattaatttagctatcgctagtgggtaatatcgaacgtaggaaagcattttactcctcctcaaaacgtagttacaaagtagtttctaactggaattcggtgactacttgtttgactttcgaatataagcctgcatattttgccaattttgtttgattttccaatcgttcaatttgaccgatttcaacgattaattaagtggagtacacctttccaatacctggaacaccgggcaaatattgatattctcgaatgccgacaaataattgcttgattgcttttccaagtctttgatgttcttttcaagcgcacgaatttcacgtacaagaacacttagaacgacattgctggattcttgtgcaagtctacctaaccgataactcatggtaattgcacgttgaatgatttggcaattttttctggatctttaaagtaaccttttccttcttcttgtattaagtcacagaacgcctctaaggcttctttagctatagtcgctgcatccgcaatatttccatagttactgcaattccttttacggtatcttcacccatgacaaccattctaaaaattttcgctaactcgtccattccagctggaaaagaatcccaaaaatcaatatcataattaccattttaggcttctaaaacaaaactacaccaagaaaggatatcaccatggatcattgtactaaaaaattgggttctatgataaatagtgttggtgaccaatactatttgacacagaaccatttaacttaacttgatgcaaataataacttatctaaatcaaatatctcaacatatttttgagtatgctgtttaattaaacctctctcttccaatgatgagaacttacgacttattgtttctggggttgtacccaagtacgaggctagatcttttttcgacattggtaaagtcacataagtatggttttcttcatcttcaacgtattctgatagaaaatcaataatacgagactctacttgctccataccaacttgcatcgtttgcttttctgatacctgtaaacgtttcgtaacatctgatagtattcttctcataatttctgggtaagcgcctaaatagtcatccatatcctttttatgaattctacatatgctcacttctgatattgcttcagcataattagaatggtaactttcagtttgaaaaatagccacttctcccataaaatcaccaggatttaatatgcgtacagtttgttcacgaccagattcatttaagttataaacacgtacacgcccattatttataatataaagtgtgtcatctttatcaccatttccaaataacaacgcattctttgcataatgtacttcttgcgctgattgcgcaattaaactcatttgttcttcatttaggtgattaaaaattggaactaaacgtatacaatctatatgactatggtggtgatggtgtgccatacaactttcctcctaattaatcgttatctatatagtcatcatcttctaacgcatccttgttaacaaaggcttgaagttgccaaatatttatatctaagtaatctttataactaattagtaaatcttctaatgcatcatctgcttcttcttgtgctaaacgcattgcacgaacggtgaattcacgattagtcctaaaatcttctactaactgtatgaccatttcttcagcagaataatatttttcagacggatcttcagaaattattgtaaattcctgaaattcagtagttgttgaagctggcttaaatcctgaagctagtaaacgttctgcaatcttatcaaaccatgtctcattctcattgtataaattctcaaaaacactatgcaatgaatagaaatttgtgccttttacataccaatgatattgatgtaattttacatgtaaggtatggatattagcaagtatatgatctgtgacagctacagcattaatcttagtatgatgaatgtgttctttatatgctttttcagcagctaatttttcttgtctttcatttgctgttgtcattttatacaccttcctttacttttgaactaataactgaatatcctaggttttcaatagctctttcaattgtactcaaattgacttgttcttcatcaaaatctacttttaccttacttgcattgaacagtatttttacagaatctttttctacaccagctgtctgttttaaaccactttcaattttttgtaaacatgatggacaagttaatgtttctaattttaatgttgctttagtcatatctatcactcctttaaataaattgtacaggacatttcttttaagataattgacatagatcaattatcttaattgatatcttcttaatctcattgcatttaaaataactactaaaatacttgcctcatgaactaacatacctatcgacatagacatccattcactaaatattaaactaaccaataatattatcaccacaccaacagcaattagaatattttgtctcatattcgcatatgtccctttagctaaacctaaagcatgggggagacgattaaaattggaattcattagaacaatatctgaactttcaatagccacatctgtcccatttcccatagcaatccctacttctgcagtagctagagaagggctatcgttcacaccatcaccaataaaagcaataatttcaccagtagactgtctttcttttagaaacgcttgcttgtcctcaggtaacatatcgccatgagcctcggttaatcctagctcctttttaactaaattaactgtgccttgattatcccctgataatacagtgagatttttaacaccaagtgattttaatttttgtaggtcttgtttaacacctgctcgaacttggtcacggattcccattaaaataattaacttacgatcaactgtcgttaatacaatactcttcttttttttcaagaactcaaaaaagcggaaaatcccagatttaaaaatctgagtttccgcttttgtcatttcaaggatggactattgtctcagcctcttctaatttattcttaagatatttttactttctctgcaggtgctgatacttctttttgttcttttcgacctttcaacttatacttcattaatctcatgccattgaaaattaccaccaagatactaccttcatgaaccaacattccgatagacatattcatccattcgctgaagaagacgctggtcaacaagaccaacactactccaattgaaatcacgatattttgcttcatattatttgcggtggcttttactaatcctaatgcgtgaggcaagttgctgaagttcgagttcattaaaacgacatcggatgtttcaatcgctacgtccgttccgcttcccattgcgattccaatgtctgctaaagctaaggacggactatcgttaacgccatctccaacaaaggctacaatttgaccacgttgttgaagttttccgatataagccgatttgtcttccggcaacatgtggccgtgagcttcggtcaaaccaagttcgccggcgaccacatcaacggttccttggttatctcctgaaagaacgactagatttttcacgcccaagtcttttaattcctgcaaattagctttcacacccggacggacttgatcgcgaatgcccatcagtacttttaattcaccgtcgaccgctgtcaaaacgagagagttcccttgttgttcaaaccgtttgacatctttttgcacttttttgctgagagtgacattttctttttccatcaaggccacattcccaacagccactctatgtccagctacacttgaaacgattccgccgcctttcacgacttcagttccttcaacaggataaaaatttgtttctccaatttgatttaagaccgcttttgctaatggatgatctgattcccgttccacactggccagatagccaagcgtttcagcagaatctttttcatacagttcagtcgctgcaacggttgggtttccgacagttaaagtacctgtcttatcaaatacaattgtatccacattgctgaagtcttgaatgacttcactcccttttaaaagaacaccgttacgagcaccattcccgataccggcaacgtttgagacaggcactccgataactaatgcgcctgggcaacctagaaccaagatggtgattgctaactcaatattttgactgaacgcccatacaacaattgccagaaccaagacagctggtgtgtagtatttagaaaagcgatcaatgaaccgttccgcttcggatttagaatcttgtgcttcttccacgagttcaataatttttccaaatgtggtgtcctcaccaactcggtcagctctgatttgaatcgttccgttttctaaaatggttcctgcaaaaacttctgcatcagctagcttgttgaccggaacagcttcccctgtaatgctagcttcattgatatgcccttcgcccgtaaggactgtgccatccactggaactttcgcacccgttttaacgagcaagatatccccttcatctacatcatccacttctacttcttcaaattcgccattatccatttgtttcaaggcgctttcgggtgccatttcagtcaattctttgatagcagatcgcgtttggttcaatgttcgttgttccaagtagtgtccgaataagaataagaacgtgacaatagccgattcttcataattttgaataaaaagcgcaccaatcgctgcaatactgactaagacatcaatactgatgactttgactttcattgcttgaaacgcttgaatggcaattggcgtaatcccaaagacagaggcgatgatcaaagaccactctgaaagtcctacgttttctaaaacaaagtgactgaagaaaccgagtgcgattaacaatccactgatgacggtgataacatttttcttgcttaatatatattgttgcatgctttttccctccaaatttaatttctcttttattgataaacacagtataagataattgcctaagtaattaattgactgacatcaagttttgaaaaaatacgtgtcccttctcactatttttttgatctaacagcctcaatgacacttattcctctttacagttataacgataccctctttttatcgaataaaaatttacggctatcaagtttagaaagttctcttttatcgtttctaagcacctcgaatcggattgcaacaaaaaagcaatcccggaaaaatagcttttcttccagaattgcctagttcatttaatctgttaagcggccttgacttttgctttaaggaccggatagcctacgttttcgatagctttttgaatctcttcaatcgaagtgacagctgaatcaaaattggttttgactttgctggagttgaataatactttaatgctgtctttatcaataccgttaactgatttcaaggcaccttcaattttttgcatacaacttggacaagacaacgtttctaattgcaatatagctttttccataattcctatctcctttatgtgtttttattttatccgcagcagattaatgaacactgccttttcctctttacaactgtagtatagctcacttttagcaaacgaaaattgacgcatatcaagttttgcacttctttttatctttttgctcaattcaccatcttaatagtctttttctgccccttattgccatcagaataataataaattggtggatagtcttgtctgcgtataaaccatactacaatcgcgccaataaacagggccagagacaaggcttgcgaaacgcggatccactcgccaatccataaactgtccgttcgcataccttcaatgaagaaccgacccactgagtaccacaaaacgtaactcaaagcgacttctccttgacgcaaaagctgttttcggttccgtatagtgacgatgaggacaaagcccaacaaactccacaatgactcgtataaaaaagtcggatggtagtaggtaccattgatattcatttgttcaatgataaattcaggtaaataaagattttccaagaattgacgagtaaccggtccaccatgagcttcctgattcataaaattgccccaacgaccaatggactgggctaacaatacattgggcgctaaaatatcaagaacgagtgccaaagaagtaccttttttctttgcataccaatatagcgtaccccctcctgcaatcaatcccccataaatcgcaatgccgccattccaaatcgcaaggatttgtcctggattttgcagataataaccacgttcaaataacacataataaagccgagcgccgaggagtccaatcggaattgcccataaggccatatcgataatggtatcctcttccagtccttttttctttgcttccttggtgctcaactggagagccgctaatatgcccgctgcaataatgactccataccaatgaatcacaacagaaccaatctccaccgcatggggattcaaaacgcctaatacgaattccattctatttgctccatttcttcaatttttcgcgtcattctagtcatggtgatgctgaacaagattccggctaagctccatggaaaccaaacagtaaatacacttttatctccctggtcactcgcttcgtaatacgccacttttccgtgtccgattacgccggctccttttacaacttcctcttctttttccatagctaacctatctgcctcaacaacgttagacgtttttgcttcgccgccaatcgtgttcttggtgaaagggacgacaaagaatgcacccgctgctgacaacgtgatggcaactatcacccaaaaataatgcacattcacccctacttatttttacgttttgttcgacaaccctatcttaaagaaaaataaaacaaaaaaacttgagggttatcatgtttgtgcttttatttttccaatgaatgaaggtcgttctgtcttaaaaaagccaaaaacggacagatggaagcaaaagcactgagttctgtcccgttgttaatgaagagcgacagaacaccaacgtgtagaaaaaagtgtgtccgattattcgctgtaaagcaataaatcatctaaatcctgaatcttgatccttttcccagacagctgttgaatcaatccctcgtcctccaattctccaaatttgcgactgatggtctcaggtgtcgttcctaaataggaagcaatgtcctttttttccatcggcagggtgatggtgggagagttgcccatttcaggttccacattttctgccaaaaacaaaactaaacgggtaatgacactctccaaggctacttgtgtcgtttgacgttctgaactttctaaccgtttagacatttccgccaatagttttaaagaaatagctgggtattgttccagaaaatcttggacatctttttgctgaatcatacagacaacggtatctcgggttgcttcggcatattcctcgtgtactgcatccgggttgaacaaggtccattctccggtgaaatcaccagggttcaagatccgcactagctgctctttgccagagtctgccaatcgataaatacggattttcccacgattgataatatataaagtatcctctttttcttgtgaacgaaacagaaactctcctttttgatactgtttcgtgtgggctttttcagcaatgtaattcatcgcgctatcctctaagtgattgaatattggaaccaagcggatacaggctgcgtggtcgccaatttcatgatgggtatgtttagtcaattcattctccccctttatttattttgtttatattcgctgcttttattatataagtctcttactacaaaaaaattgatgcacatcaagaaaatggaaaaaggactggaaagaattccaatccttaaatcagcttctacttttaccttaatcttcatcctcatcaagagcgtcatcatcttctaatgcttctttaccaatgaacgcttgcagcatccaaatgttcttgtctaagtcatttttaaaagcaatcaatgtatcttctaaagcatcgtcaccctcgtcttgagctaaacgaatcgcgcgaatagttaggtcacgagtgcttctgaagtcctcgataatattttcaaccatgtcttctgctttagcgtatttattaactgcatcttccgaaagcatcgaatatttttcaaattcaaccgttgtcgaagcaggtttatgcccagaagtaattagacgctccgcaagtttgtcgaaccatttttcattttcgttatacaactcttcaaatttttcatgcaacgtaaagaaattggctccttttacataccagtgatattggtgcagtttcacatgtaatgtatgcatgttgcctaaaagatgatccgcaatggccgctgcattaattttcgtatgatgaacatgttccttgtgttcttgttcttcttgcaatctttcttggggtgttctttcttgagtagctttattttcagtcatgatttattcctcctataattttggtttgtttaaaatagctttctttgattcctcctttttctttactgaatttagtataggatagatttccgttaaaaaaattgacgctcatcaagaaaagtatttcttaatagacgccaggcttctctattaaattcaactgaaataatcaaaggaatgaagtcgttccctccaaacaaaaatttcattaaagtagggcctaaaaaaagaatagcaactatactttgtcaagagacctgactgctatttttttgcttgttattcttcaattaccaaatgtcttgccttgcagtatatttaatgctctttctcactagtgttgcatgcaacactagtgagaaagagtattaataagattaacctagaagaataactttactttatttatgtcataccataaataaaaattgaaaagaattttttatttatttttagtagatcgattaataggagttttagcttgggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaaacatctaccacagtagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccgtttttttttgtgtcatggaaccttgatataaccggcgtgaaccaatagttgaatgataatgactagtgtattcattcccacgtgggtaatcatcgatgtccagatacgtcctgtcaacgcataaagtccagagaaaaagagtcccaatagaatatacaccaacaagtgattgtcactgtgtgcaaaggcaaaggcgacagcactgacaatgacacctatccaaatattcgaatagtttgcaatgattcccacaagggcacggcgaaatacaaattcttccatgataggtccgccaatcatagcggcaagggcaaaaatcgggttttgcagaataatagtgataatattctcagtattctgcgatgcagccacttcgccaaagagcgactcaataaagacagcgaagttttgcaaaagaatggcggcgatgattcctgttaggccataaacaataatagccgatacttttggctgcttgcgttcaaacgacagcggttcattttgtttaaaataaagaaaaatcatcaagattgcgccggcgatatacgaaacggttgtggcagggatcgtagcaccactagatataaaagcgacaggaataaaaaatgcgaccccataaatcaaaatcgtcgataatgcgtacttttttagagacataagtgaaatcatcacactcctttttttctattatagactagtgactcattagaaacaaaatttttccttaggtttttacggtatggagcaataaaaagaaaaagctaaaataaatttaatcaaaaggcttgcaaaaaaaacagaaaatgagtaatattaattttgtgagttagcactctatgtatgagagtgctaacggaaattctatcaaatacaattggagggatttatcgtgttaagaccattaggtgatcgcgtgattatcgaagtcgcaaaagaagaagaaaaaactgtgggaggtatcgtgcttgcttcagcagctaaagaaaaacctcaaacaggaaccgtcattgcagtcggtgaaggacgcacgctagaaaacggtgaaaaagctcctgttgctgtcaacgtgggcgaacaagtcatgttcgaaaaatacgctggcacagaagtgaaatttgaaggtaacgaatatttgatcgttgctgcaaaagacattattgcagtagttgaataaaaaataatttagttgaggtgaatgtaatcatggcaaaagaaatcaaatttgcagaagatgcacgtgcagcaatgttgcgtggggtagataaattagcagatacagtaaaagtaaccttaggccctaaaggtcgtaacgtcgttttagaaaaatcttatggttcaccattgatcacaaatgatggcgtaacgattgcaaaagaaatcgaactagatgatcatttcgaaaatatgggggcaaaacttgtttctgaagttgcttctaaaacaaatgacattgctggtgacggaacaacgacagcaacattgttaacacaagcgatcgttcgcgaaggactaaagaacgtgacagctggtgcgaatccattaggtattcgccgtgggatcgaaatggcaactaaagttgctgttgaagaactacacaacatttcttccatcgttgactcaaaagaagccattgcacaagttggtgctgtgtcttctggtagcgaacaagtcggaaaatacattgcagacgcgatggaaaaagtcggcaatgacggcgtaattaccatcgaagaatccaaagggatcgaaacagaattagatgtagtggaaggcatgcagtttgatcgcggttacctttcacaatacatggtcactgacaatgataaaatggaagctgctttagaaaatccatacatcttgatcacagacaaaaaaatctctaacatccaagacatcttgccattgttagaacaaatcttacaacaatcaaaaccattgttgatcatcgctgatgatgtcgacggtgaagcattaccaacacttgtattgaacaaaatccgcggtacattcaatgtcgtggcagtcaaagcaccaggctttggtgaccgtcgtaaagccatgttggaagacattgcgatcttgactggcggtactgttatcactgaagacttaggtttagaattgaaagatgcaacgatcgacaacctaggacaagcaagtaaagttgttgtggacaaagacaacacaacaatcgttgaaggtgctggcgacaaatcagcaatcgatgctcgtgtgcaattgatcaaaaatcaaattgctgatacaacatctgattttgaccgcgaaaaattacaagaacgcctagcgaaattagcaggcggtgtggcagtcatcaaagtgggtgcgccaactgaaacagaattaaaagaattgaaactacgcatcgaagacgcattgaacgctacgcgtgcagcagttgaagaaggaatggtatctggtgggggaactgcccttgtcaatgtcatcaacaaagtagcagccatcgaagcagacggcgatgcagcaaccggtgtgaaaatcgtcttgcgtgcgttagaagaaccagtacgtcaaatcgctgaaaatgctggctacgaaggatccgtgatcatcgacaaattgaaacacgcagatcttggcgttggtttcaatgcagcaactggcgaatgggtaaacatgcttgaagcaggaatcgttgacccaacgaaagtaacacgctctgcgttgcaaaatgccgcttctgtagccgcattattgttaacaactgaagcagtcgttgctgacaaaccagaacctgctgcaccagcagctccagcaatggatccatccatgggcatgggcggcatgatgtagttatactaaaagaaccccttagcaaggggttcttttctttatgcttctatttctatgatagaaaggagcaaataccaatggtccattgcttgctcattggtatattgaattccttatcattttggcattcaccgctaacatagctcaaaagagatactccatatttttacaccaaataggaattaacttcatgttgaatgattcagtgaagaagtttatgatcaatctatcaaatctatttcattttcattctctttttgagacacccactcttcctacaagagtgggtatttttgcttaaaaagtagtccttttactcaaaatgaacgtgcgccttactagcttgatttttattctaactagcaaggagcagtttcatgtagcacttttttatcaagacagcggatagcgctgcatattttctgtctgtcctaaaatgtaatctactgacacatcataaaaggcagcaagatgcaaaatcgtcataacgtctggtagacgatcaccagcttcgtaatccaaatagtcttccaacgatacatcgatttgctgcgatacctctttttgcgtcaatgcttgcccttctcgcaaaaatttgaatcggcaacgcaatgtatccaataaaaaagcttcttctaatgtcaatttgcgttcctcctcgaatggaaaaatgattgatgacttctctctccatttctattgtaacaacattctagaaataagcgaaatgattcacaacatcagaaataaacaaggagaaaaaaagaaaacaaagtgcttgctctggtacgcgtttcatagattattctattcatgaaaggggcgtatgaagatgcacacttatatggaagtaaagggaaacaatggaatacaacgctgctatgttgcacttgaatttgatgggatcaacttgattctcacgaagcccaagggattttttagagaaaaggtcgcacaaataccgcttgcagaaattgggcacctggtacaggatgaatattttggtgcgcaacgaatcagtttcattcatcaaaatgattattaccaattctatgaatgtggggcaagtgtgatagactatatgaaagaacaattatttgtctaaggagaagcgcatggcgaacattcgggatattgctaagctgaccggttattcggtctcaacgatttcacgagtcatcaataataatccttatgtggatgagcagaagcgtcaggagattttgcgggtaatggaacaagtcaactatatcccgaatcatacggcacgtgtgctaagctcgggaaaaacgaagaacatcggagtgattctcccatttgtcaatcatccgtattttgatatccttctaagcgggattactgcaagtgctttttcccgtgggtataaggtgactttgttgcctacccgctatgaaccagaaatggaagaaaagtacctgcaagaatttgcggcaaaagggtttgatgctctgattatcacatcaagagcaaatcccctcgaaaaactattgccctatcgtgcttatggccgcatcgttttttgtgaaaagatcgactctgtccaagatggatgcacctatatcgatcgtgaacaatccattcgggaagtgtttgcttatttgaaagaaaatggtatcgagcgtattggaattacacttggaagaagtcgtaagctgagcagcaattcgaagatcacagttcgtttgtgtcaggaatatttcccagcttttaccgaagaattgattttttgggattgtttgacggaagaagatgggcgagaggcagccgctttctttgctgataaaaatgtccaagcgatttttaccaatggggatcaggtagctgctggtatcaaattggcttcttcctccgaacgactacttattggcagagacaatttatttattagtgaagttcttcaattgtcaaccatcgactatcatttgcatgaatgtggagaaatggcgttgaagttagcaatccaagaagaacaagggtccatccggattccttatacgtttatcaaacgaagaggacttgagcacacataatgcggctcaagtcctttttatgggtcattaatctgcgtaatgagcgatgactgcctgtaaacagctggctgcgccttggcctgctttttgatcgtaatagtcagtaaaacgtgcatcatgaatgtacatttcacctaaactgcgatgataatcggcagaataaaatggcgctgcaagctgcagccattttttgtgcaactggaaggctgtttttgccaaagaagaagtcacgtcaaatggctcttgtaccacttgtttcaatgtttgaattagttcgttttcggtttgttccaattcttggtaggtttcaaatgacatgttctgccatttttgattgctttgttcaacgacttcttccccataagcggcacggatctcttcgccataggtttcttcattggctgcgagtttttgttgtttaaaataagtgaatttttctttatctgacatagtctgttctccttcataataattgattgtttgggctaatgttgtcaataagcgatcaagcgctgctcgttcctgagacaatcggttgtaatgagcaaccaacagtgtttgaacatcttgttcgggatcatctagcaaatgacggatttcttctagagggaggccaaaggatttaaagtacaaaatctgttgcagacgatccacttgctgtcccccataaatacgatagccggctgaattgatcctttgtggttttaataatccgatttgatcatagtagcgcaatgtacggctgctgacgccagaaattttagccagtgctgttatactatattccaaatttctccctccttatgctctcatcataaaggtttacgtaacgtcaatgtcaacaaaaaattttttgcttcgtcaaattatgttataattatagcaaagaaaggaagattcgatgcaaatagttttttccgatatagacgggacatttcaggaaatgggtcagcctgtccctgaaatcaataaaacagcgatcaactatctgaaagcacaaggcgatcattttgtttttgtgactggtcgagggtatgatctggtagaagcactgatgatagaagaaggaatctcctgtgatgtcatctttggcaatggcgccggcttgaagttggaaggtcaggcgcctgttttagccaattgtttgccgctagctaccttagaagcggtgacagctattttagagaaagaaaatgttttttattttctgcacaccgatcaaggagtgatctgcaaagatcctgcggattatcaagaacaattgaccgcattgaccaataaattagttacagatctcggtgagagaggggcgatgattgctgaatacaagcaagcctattttgtgcatgactgcattcatgcaccggatcttttagcctacattcaggaacggccgacgatcaatgtcctaaagatcgaactgatggaagcatcggatgaaaagatcgaacagttgcgtctattgctgcagactgaaccagtcagtgcgtttcagtcatttgttcagacattggaagtcgttgatcccttagcaacaaaaggagccgcgatcacgaattttatgcaggctttccctcatgcaaagagttttgggatcggggatggtgagaatgacttagccatgtttgaagtggtagatgtctctgttgcagtagccaatgcgagtgaatcgatccgtaacgtttgcgatcgtatgattcctagtgcagctgacggcggagtcggccaatttatcatggatgaactaatacgagaggatgttgtatatgaaattgattgaaacaccagtcaaccaaaatttgaatttggagacattttatccggtcatctcaaaatttatttttgataaagtcgcgattaaatactacaaactttattctcttgatcgaacccagatcatgtatgtggatacttttgacaagatcacattggttttgatcaacaataaaaagaagatcagccgcggagaagtggatacagcgattcatcgcttactaaaagttgaccgcaaggatgtcactgtagatgtcaatatccgtaaaaagatggaagcagcgggagtcaagtttgcgaaacctcgcaaagatatcatcctagttcaattagcagttgattaaccattagcagcctgtgttataagttgaagcaagacccaatgattcgagtgaaactggtggaataccccatcgcatcatgaagtttttcggtctttttctaacttatggcacagactttttttgaggaaaaaaacaagaaatactttctttttttatttttttgctataatagggagaagtaagtatgagggagcaaaacgatgcaaaaattatttaaagatgatagtttcactttgcatactgatctctatcagatcaatatgatgcaaacctattgggaattaggacgtgcggatttgaatgcagtcttcgagtgctatttccgtgacatgccctttgagaatggctatgctatctttgcagggttagaacgcttagtcgattatttgaacaatttgaccttttcagattcagatatcgattatttaagagaaatcggcggatatccggaggctttcttggattatctgaaagaattcaaatttgcctgcacggttcgttcagctttagaaggcgatctcgtcttcaacaatgagccgatcattcaagttgaaggacctttggcacaagctcaattgatcgaaacagccttattgaacatggttaatttccaaacattgattgcaacaaaagctgctcggatcaagtctgtgatcggagatgatcccttattagaatttgggtctcgtcgtgcgcaagaactggacgcagcgatttggggaactcgtgcggcttatatcggaggtgcgggtgccacaagtaatgttcgagcaggcaagatctttggcatccctgcaagcgggacgcatgctcattctcttgtgcaatcctatggcaatgattatgatgcctttatggcgtatgccaagacgcacaaagactgtgtctttttagtcgatacgtatgatacattgcgcttaggtgtaccaaatgcgattcgtgtcgcaaaagaactaggggatcaaatcaactttttaggagtacggatcgatagtggagacatggcttatatctccaaaaaagtccgagaacaactagatgaagctggctttacagaagctaagatctacgcatcaaatgatttggatgaaagcacgattctaagtctaaaaatgcaaaaagccaaaatcgatgtttggggtgtcggtacaaagttgatcaccgcctatgatcaaccggcattgggagccgtttataaactggtttcgatcgaaaacgaacaaggcgaaatgatcgatacgatcaaattatccggtaatgctgaaaaagtttctacaccaggcaagaaacaagtctggcgtatcacacgtaaaaaagacggcaagtctgaaggggattatgtgactctttgggacgaaaacccccaggaagaaaaagagttgttcatgttccatccggttcacacctttatcaataaaacagtgacagattttgatgctcgacctttgctgcaagacatttttgtagaaggacagcaagtctatcaattgccggatcttgaacacatcaaagcctatgctacaaattgtttggattcattatgggatgagtacaaacgagatttgaatccgcaaaaatacccagtcgatctctctcaagagtgctggaatcacaagatgcggaccattgaaaaagtgcgtacgcaaaccaaaacagaaattatttaattggtcctagaaagctaggaccaatcttcaaaaaaattaggaggcgtttctatgacattgcaacaagaaatcattcgcgagttaggcgtagttccaacaattgatgcgaaagcagagattcgtaatagcattgaatttttaaaagcatatcttcaaaaaaatccctttttgaaaactcttgttttagggatcagcggtggacaagattcaacactggctggtcgattggctcagttgacaatggaagaaatgcgcagtgagacgaatgatcccaattatcagttcattgcgatccgcttaccttatggagaacaggctgacgaagaagatgccaaaaaagccatcgaatttatcaaaccggacattacattacgagtgaatatcaaagcagccgtcgatgcgcaagtggcagccgtcgaagaagctggcttacctgtttctgattttaataaaggcaacatcaaggcacgtcagcggatgattactcaatatgccgttgcaggcgaaaaagctggcgctgttttaggaacagatcacgcggccgaaaacatcaccggtttctttacaaaatttggtgatggcggagctgacctcttgccgctatttcgtttgaataaacgtcaaggacgtcaattgttgcaagaattaggagcgccggaagcactgtacaaaaaggttcctactgctgatttggaagatggcaaaccaatgatcgctgacgaagtagcacttggtgtgacttatgatgagatcgatgattacttggaaggaaagaccgtttcaccaaatgcgcaacaaacgattgaaaattggtggcacaaaacacagcataaacggcatctgccaatatcaatctttgacgacttctggaaataaatcttttttactctgtgatagtttttggtccatcgcatctaggagaaaataaatatccgaacgatttatgaatgaattttttccgagaggcctcgctgtatcgctcaacgaggtcttctggatttcatagattgttcgggattttttgttttttttttatcttagtcataactctcttcaaggaagaatggcaagaataaaaaaacaaaacaagcaaacggctctttacattctaaatcgcaaagcataaaatacaggttatggttagaaaaggaggaatgtccttcgtgaaaagaaagattcatcccaagttgcagatggggctaaaactaatcggtagttttattttgattctctttagcaacctttatctacaatggtgtcaaaacaacctttctgttgagctagcattaaaatttgctttttcttggcacacagaaaagtttttcttagcttgtctggtgctgctgcttttctatgggttattgacaagtctggctggatcccttggagtcggggcgctgttttatagcattgtgatcgggatcttgggttatgcaaattacctcaagatggcttatcggcaagaaccaatctatccagatgatttgaaaatgatcactcagtttgatttgctgcatacgatgatcggaacaggccccttcgtcttggcgatgctatgtgtgatactcgcagtgggagcaattatctggagtatttatcgcagccgtaaattgtcaaaaaagaaacagatcctcagagggctgacaatgctcgtttgtacaattggtttggtttatgtttcgcattttaatgacagcaataatttgcttagaaaagcgtataaccggaccgcattatggatcccttattcacaaaaaatgaattactacaataccggttttattggtgggtttctattcaatctgcgggtcgatgcaatggaacaaccagcgggttattctgaagctgcgataaaagaaattgccaaaaaatataccgctgaagctggcgaaacaaacaaaacgcgtgaccaagaagcgccaaatatcgtttatgtcatgagcgaaagcttttctgatccgagccatctaaaaggactgacgattacaggggatcctttgaaggattattatgcggtagccgatcaaacgatcagtgggaaaatgttgtcgcaaaattatggtggcgggactgcaaacattgaatttgaagcattgaccagtttttcaatggggttgttgaatccgcaaatgaccacgccttacacgatgctggtccctaaattgacacaattgccttcagtggtctcattcttgcaaaaacaaggatatgatgcgacagcgatccacccctatgatacatcgatgtacaagcggaaagatgtctatgatgtgatgggttttcaaacctttttggatcaagacacgatgacttacacggacaagatcgagaacaatccttatatctcggatgcttctgcttataaagaagttctgtctcttttgtcagatgagaaaaagccgcaattcgttcacttggtgacgatgcagacccatatgccttatgaaggaaagtatcagacattaaattatcaagccacaggcgatggaaatataactgctcttgaaaactatctgcaagatatctcttacagtagtaccgcactaaaagactttattgaacaattgaagcagctgaatcgaagaacagtagtcgttttctggggggatcacctgccaggcatctactcggatgcgattaaagatcaaaatgatactgctgcgctgcatgaaacggaattcttgatggtggattctgatggaaccttttcaactgacactgttccggtaacgagtcccttttactttgcacctaacgtgttgaatgaaagtcagcaaccaatcaatggattttatgcgttgctgctagcactgcaagaaaaattgccggcttttgaacatgggcagtattaccaaggcgaacagtggcgaagtgagctaagcttagatgcgaaatcacggcagctatatgaagactatcagctgattcaatatgacattttacaaggaaaacaatatagtttacagacagatttatttggctaagaaaaattgtctaacataaaaaggctgtgacaaaagaaggatcaaggaagaaacacattgctcttattcagagtaggctggtttcttcgctaaatgtctttcttttgtcatagcctttatttattgagcaatcctagcgatgtgttttaagcagcatgtctctactaaggatcacagatttcttgtaggtcattatagatcttgccaagtccgttgctgattgaagtaagctgcttcattttcagcctgttcaacgattgatttcggataaccaagcactcgcagtagggcaatcgcattacggcttgttgaaggaccttgtttgaccttatagtcaaaagagataccgtcatcggctgtgacttgttcagaaaaatggatattgctgcagtcatttttcaatatttcagtcagttcaatatcatgagtcgcaataaaagccaaacttgtataacggctcaaccaatgaatgatactagcagaagcagcgatccgctcaatcgtattggttcccttcagtatctcatcgacaaagcaatagcagcgttctttttgctgaacttgttccaacaatcgtttgatcgacttgatttctgcaacaaaatagctatcgccctcaaacaaatcgtcttcgaccgccattgaggtcaacacatgaccaggttccatcgtaaaggattcagcaacagctgtttggatagtttgcgccaatagacaattgatagcgatgcttttgacataggtcgatttgccagaagcgtttgacccggttaccagtgtattggtttgccagtcgacatcattcatgacagcttcagtcagaaggggatgataggtcccttttgcgctgaccgttccttttttgaattcagggatacaagtgatcggcatataggtacggaaattaaggatcgcgcaagcaatttccaacttgcctaacaattcccataatgcgatcgcttgttgattgtatcgagccaataaggtaacgacgtaatggtacgagataaaaggcagcataaagatgatattgatgtattcaaaaagcatatcgccttcactgccattttttgaacgaaaagaaacgccgaatcgggggatttttttcagaggcagcagttcttttttgatttgctcttgtaatggtgtggcaagtttggcaatcttgttgccgcaggccactgtctgaactagatagcgcatactgttgagttctgtttctagtgtggcttttttgatcgaatagtaaaccgtattaaagaggacgcttatcaaaatcactgcaattcctggcaaaaagccaaaagctatcaaaatcagcccaacaatcggcaaacagcccaataaaataaagacaggcaagttgccaatactttctttcttccctgatgccagatagtttttggaaaagttattatccagtttcccaagttgggcaaaggtatattgggtatcttcgcgaatttttggattggctgcgaaaaaatcaattaacgcggtcagctgtcgatccggcttaaattgaaagttgcgcaactgctgatagagagcttcagaacctacactggagtaagtactgttgatcatttcaaaaacctcgaataagtctaagtcataccaagtaatgtcatcgatctcactatcatggggataaaaatctttctctaccatccaggcctttttgaggctttcttctttgtcaaagcgaggctgacgggggaattttccccattcttgtttgacgcgacgtcttaattttattcggttccaagtatctaagccaataataagtgcactaacgaacaagataatcaagataaccatatattttgcgtccatgtttttctccgtttctaggagcaaaagcaggatctagctcctgctccttctaagttaattgattttacgcaagacatcataaatgcgtgcgatgtcctgcgttgttcctcgcagttcaaaatcagctagaaatggaatctggaactgttcagcatattgtttggcagtcaggcagtattgataattgaaatttttgttgccgctgccgatcacaccgcgacaatagcgggcattatccgcataatcaatatactcccgcatggtttctgtcaaaatttcctgatccccattatctacgccgttgccgccttcaagataggtcggcacaaacacgacaaaaggttcgctttcttcttcgaaaatggaattgtcatcaatttctttgacggaccattctagaggatgcgctgttggctgctgggcggcatagtccattagtcgtttgacaaatgcccgggtatttcctgagattgaaatataaagtagtttcatgtcatcaccttccgtatccagtataacagaatcaaaataaaatagagcaggtcttttgtagccaaaggaaggaaaaataggtaaactaagtagatagaaaaggagtgagcatatgttttctgagatgcatcatgtggccattattgccagtgattaccaacgagcaaaatcattttatgtcgacaaattaggatttaaggtgatccgtgagcaccatcgtcccgaaaaaaacgataccaaaatcgatttggcttttggctcatctgagattgagttgtttatcgtggatcaaccacctaaacgagcaagttatccggaagcaaccggcttacgacacttggcttttcgagtaacaaacattgagaaaatggtagcagaacttgaaacaaaaggaattacgtgtgagccgattcgctttgacagctttacgaataaaaaaatgacattcttccaagacccagatgggttgccactggaactacacgaatagtatcgaggattcattcgaagcgcaacgacacttttttacttcggatgacaaaaaaatgctgttattctgaagaaaacacaaggaggagaaatcgtgattcgatttgcacaaaaagaagatcgttttgctatggcgaaacttgttttagtcattttaaaagatatggaattaccgtttgtggcagaaataggagaagaaaaaacgctcgagatcttggctgaagcgatgttagagcctgattatcgttatggttataccagaggattggtcaatgaaatcgatggacaagtggctggggttgcttttggttacccagataaagatgaacctaccattgatgaaccgttaacgaagattctggagtcctacggtttggataaagaaatgaaactgttcgttgatcaagaaacgttgcagaacgaatggtacttagataccatttgtgtcgatgaaaaattccgtggaaaaggggttggctcagctttattggctgcactgccaaaaattgcccaacgagatggctataccacaattggtttaagtgtcgataaagccaatacacacgccaaacgtctctatgaacgtcacggttttcaagtggttgctgaacgaaagatcagtggtcatctatatgatcatatgcaaaaagaaaccagttgagtatctcaactggtttcgttcgttaatcgtaactccaaatgttgctgggtcttgcgtttgcgattatagagccaataatccataatcgcagcaatacaaatgcaaactggcgcatcctcatcgttgaccacatcgatcacataataatcgccagtcaatagtgttgctttatccatttccatgatcttcttgttgaaatgatggatcgcataccgatgattgtagatatccccgtggacagcccaatggagctgttggatataataaaaatccccaggccagttgaaaattttttgtaacgtacctactttttcaaagtccttgtagatctcaaatcgtgtgccaaaggtaaaactgatttgcttaatactggcgaccagtgtgccgtccaaacgatagagggaaagtgcatcgcctttagttccccagcgcccgaccatcaagaataacgatttgcccttttcgtctttaacgatcgttcgcgtgatactgctgagttgtctgtcttgaataaaaaattccgacatatctacgcctcctcttgtatcccgaaaagctgcgtcaattataaattctcatcgattgcccgaataattgctttgccgactcctgattcaatgttagtatccgtcagatacttcgcatattctttgacttcgatttccccgttacccatagcaaagctgacaccagcaagctgtatcatgctgacatcattcaagttgtcaccaatcgtcatgacatccgacagttgaatcgctcgctctttagcaacgtgtgccaccgcgatccctttttgggcattgcgatgattgatttcaatattgttttgtccggaagaagtaaccactaagtcgccataaccatcgatttcttgtgtgatcggtcctaaaacacgcgcgccatcttgatggaagcaaatgatttttaagatttccagatcttcaatcgcaaacagttcattgaagtctttgacataattgatgggaagaaaagctagtcgtgcagcagtcatggcaatggccattttgtgggtcagatggggcattgcttctgctgtatggatcgcaaaattctcgattcggcgcgtctggctttctgaataaatgccattgctcgtggaaatctcaaaataaatgtctttttctcttaataagtccatcaatgaacgggttttttctttagaaataggaacggtgaataaagaagttcctgatttgtcaaacacttgtgcaccattaagtgtgatcatagcacaatcaataccggcttcttgcaaaggcggcagagcttctttccggttgcgcccagtggccaccatgaattcgactccttgggattgggcatatttgatcgcttggatattttcttctgaaatctgcatgttggcgtttagtaaagtaccatccatatcagaagcgattaattttatcattgtcagcgtcctttcttatggtttctatagaatagtgtaccacaaatcagcaattatttttgagaatgtcttcttgtttcttaggcagatcttttgttatccttaactaaaagcaaaggagcgagacgatgagaaagattttagaaaatgattggcaagaagttttgcaagcttccttcgatcaaacctattaccaacagttacgggaatttttgaaagtagaatatgcaacacagaagatccacccggcaatggaccatatttatgaagcactgaaactgactccgtatcatgaagtgaaagtagtgatcttaggacaagatccatatcatggtccgcatcaagcccatgggttatctttttcagtccaacccggagtacggattccgccttctttacgcaatatctataaggaattgcaaagtgatctaggcatcgcgccagtctctcacggttatttggttccttgggcgcaacaaggaattttactactaaatacggtgttgacagttcgtgaaggacaggcttattcgcatcgaggcaaaggatgggaacgattgacagatactatcatcgaaaagctgaatcaacgggataaaccagtgatctttgtattatggggaaaaccagcccagcaaaagaaagcgttgatcgatacgaaaaagcatatcatcatagaatctccccatccaagtccgttatctgccagtcgtggtttctttggatcgaaaccattttcaaaaatcaatcaagcattgatcgcattggatgaaacaccaattgactggcaattaccagaaaaaatagtacaggtgtgaaactgtagtagtgcagaagagacggactgtgaattgtgtaacaaaaattatctttttcgattagtacagcatttttatctgttcttttttttgcaactattgtacaatgtaagggtataaaaaaactggaggtctttacccgtggaactattcgaaagtttaaaatttaaaatcgtgcgtcgtcatatcaaaatcgttttcccagaagcaacagatcctcgtatccttggtgcagcaagccgtctacgttcagaagaattggtagaaccagttttgattggtaaccctgctgagattgagaaagcagcggaagctcgaggaatcaacatcgctaattttgagatcctagatcctgaaaactatgaccggtgggatgaaatggtcgaagcttttgttgagcgccgaaacggcaaagcaacaaaagagcaagccgaagaaatcttaaaagatgttaattattttggtacgatgttaacttacatggggatcactgaaggaatggtttcaggtgcgatccattcaacgggcgatacggttagacctgcattgcagatcattaaaacaaaaccaggcgtgagccgcacaagtggtgcctttttgatggttcgtggtcgtgatcaagaaaaatacctattttctgactgtgccatcaatgtgaacccttctgcccaagaattagcagagatcgctgttgattcagcaaaaacagcggaattatttgatatcgatccaaaagttgccatgcttagcttctcgacaaaaggttcagctaaagcaccagaagtcgataaagtggttgaagcaacaaaaattgcccaagaattggcgcctgagtacgaaatcgatggtgaattgcaattcgatgctgcttacatttcagctgtcgctcaattaaaagcaccagaatcagaagtagctggtaaagcaacggtctttgtcttcccagatttacaatctggaaacattggctacaaaatcgcacaacgcttcggtaacttcgaagcaattggaccaatcctgcaaggattgaacaaaccaatctcagacctttctcgcggatcaaacgaagaagacgtctacaaactatccatcattacagcagcacaaacattgatggataaataagataactaatcaaacaaccaagccgttccttttgtcaaggaacggctttttgctgcgaatcacaacgattggcttgcatagcaagacagagttgatgatgagcagtactaggcgaccaaagggagcgtagtaaccttcagcctgaatcacaacgattggcttgcatagcaagacagagttgatgatgagcagtactaggcgactaaagggagcgtagtaaccttcagcctgaatcactgcgattggcttgcatagcaagacagagttgatgatgagcagtactaggcgactaaagaaagcgtagtaaccttcagcctgaatcactgcgattggcttgcgaagcagagagcagatgatgagcagcggggaccaaagaaagcgtagtaaccttcagcctgaatcactgcgattggcttgcgaagcagagagcagatgatgagcagcggggatcaaagaaagcgtagtaaccttcagcctgaatcactgcgattggcttgcgaagcagagagcagatgatgagcagcggggaccaaagaaagcgtagtaacctcagtatgaatcacaacgattgcccttagagtggcatggaagtctagttagcgcaacaagcttagaaacaattgcaggcaaagcaagatgaggggcgtcgcttccaaaaatactgcccacagcaggataaaaatggcttttctttcaaactccttgcgacggtacgctctttacttttgattctaaaacaagctatactaactactaacagcaagtgaaaagataaaggacggatcaaacatgataacgatcgctgatttagatgcaacagaaaaatttgccgaagtgattggcagagtggccctgcctggagacaatttggtgttaactggggaactgggagccggtaaaacgacgttgaccaaagggatcgctcgaggtctggggatcagtcaactgatcaaaagcccaacctatacgattattcgtgaatatactgaaggtcggttgccactctatcatatggatatttaccgggtagaatttggcgcatcagacttgggattagatgattattttgaaggtgatggtctttctgtgatcgagtggggaaatcttctggaagagtctttaccggaagattatttggaactgattttggaaaaagataatacagaagagcaaaaacgttttgtgaaattgcttacatttggtccgaaagctgaggctttccaacagcgtattttggcgcaatgggaggcagataatgagtgacattcatttgacattgcgtgaggctcggggcgaagatgcggcagaactcttggcagtcagtcaaaagattggtcaagaaactgactttttggtcatggatgaaacaggcctcgccctgcctgaagcaatgttggcacagcaactagaaagcttgtatgaacaagacaatcacctcctattgttagcccttgatggagaacgaattattggtatggcttctatcaaaggttattcggaatggcgcatggcccatgtaggagaaataggtctatcgattttaaaagactattggggaatgggactagggtcacttcttttagaagaattgcttgaatgggtcagtgaagtagggttgttgacacgcttggagttgacggtccaagcgcgcaatgaacgagctatccatttatatcagaagtacggatttgaaattgaaggttgtatgaaacaagccgcccaaacaaaagatgggcaacgaattgatgttctaatgatggcaaaattagttgatgaggagtgagaaggatgatcctgcttgttgaaccggccctagcagacaaagaacagttaacagcttatcgcgcatcatttttagaagacaatgaaactatccacggaggttctgggctagaaacagcggagacaatcgaaaaatggcttgaactgcaagaagcctacaaatcaccggcaactgttcctgctagtcatgtcattagtcgggtttatcttgcaaaacaagcagatacagtcatcggaatcttgaatctgcggctagagctcaacgactatttgctgcagcaaggcggtcatatcggttattctgtgaaaaaaacgtatcgccaaaaaggatatgggacagcaatgcttgctcaatccttgtcgattgccaaaagcttcggaatagaaaaagtactggtgacatgcgatgctcacaatcaagcatctgctaaggtcattgaaaaaaatggtggtcaattagaagatatatggatcgatccggtaaatgggaatagtactcgtcgttattggctttcaacaaataactgaaagacaaaagagtaagaaagtaagaagaaaagtaaaaaactgatactcattttacgagtaccagtttttttaatgggtcgatcccgaaatcgttttcttgacgtaataagatctgagcacaggcacgactatcttcaagggcgtcgtggtgattcagcaaaggaatctgcagctgttggcagacagtattcagcttgtgattctcgaattcaggatagagtttgcggcttgtacgtactgtacagagtgaaagataatttggctgttctatcccatagtaatcaagacatccagctaaaacgccagtatcgaaaccagcattgtgggcaacgatcagactgttgagattataatattgctggatttgtttccaaatgtcaggaaatttaggagcattgacgacgtcttccggatgaatgccatggatttggatatttttccaaaagaaatctgtctccggctggatcaacgtgtagtattctccaacaattttactgtcccgaaccatgactaatgccaatgaacaagcactgtgcttttgataattggctgtttcaaagtccattgcgataaaattcattgccttcacctcaaagctattctagcacaaatctttgaaatgaaaagatacaagatttttttggcaggatggccgataggacacagcgaaagaatatggtaagcaattagtttaactgcaattcgacggggcaatgatcactgcctaagatttctgtatggatttttgcatcaaccaggcggtcatttaaatcgtctgaaacaacgaagtaatcgatgcgccatccagcattatttttgcgcgcattaaaccggtaactccaccaagaataaatcccttcagcatcgggataaaagtagcggaaagtatccgtaaagcctgctgaaagtaaggttgaaaatttttcccgttcttcaggagtgaagccggcgtttttttggttggttttccagtttttaagatcaatgttttgatgagcgacgttcaagtcaccgcataggataactggtttttgctgtttcagatcggtcagataggcacgaaaagcatcttcccatgtcatgcgataatcgagacgacgcaattcattttgggcgtttggtgtatagcaagtgactaaaaagaattcggggtattccagggtgatcacccggccttcggcatcatgttcctcgatgccaatcccataatgggcagcaagtgccggttctttagcaaagatcgctgtaccagagtatcctttcttttctgcataattccagtattgcgtgtatcctggcagatccaactcgatctgccctgcttgcagcttcgtttcttgcaaacaaaagaagtctgcatcgaaggtctcaaaggcttctaaaaagttctttttgacgattgctcgtaagccattcacgttccaagaaataaatttcatatttgtcctcctcggttcaactatattttccattctaccgaaaaaaagtgtaagattaaagcaagacgtaacgtttaggaggaatcagtcatgaagatcggtgttatcgggttaggaaatattgcacaaaaagcatacttgccaagttatattgcattgcaggatcaagcggatttttattttgccacccggcgtgaatccgttcagaaagaattgcagcaacgttatcggttggcgcatatgtacaccaatttagacgagctgatcgatcagggaatcgaggcttgtttcattcatacagctactggcagccactatgagttgatcaaaaaatgtctgacagaaggaatccatgtctttgtcgataaaccggtcagcgagaattttgctgaagtagaagaattgtttgctctagctaaagcaaaacaaaagttgttgatggtcggcttcaatcgccgctttgccccgatggtcgatcaattaaaacaaattccggataagcggatgatttatctgtcaaaacaccggcaagctgctagtcatgataccaagtatgtgatctatgatctcttcttacatttggtggatactggtgtctatttattggatgaaccgatcatcgcgcatactagtcagatcaaagaatcagcggatggattggagacggccacactgatcttggaaacagcacatacaacggcgattttgacgatggatctcaagagtggtgccaatacggaagattaccggatcaccgccaaaagcggaacctatgatgtgaggaatttgactgctcttacggagtatgtggaggggaaaacggtggaacatgagtttggcgattgggaaacaacgttgaacaaacgagggttctatccattagtttcggcatttattgcagcagtcgccgatccaacagctatcgatctgcgccaagcgcaagtgatagacagtcaccagctttgccaagaaatgatcgctgccaatcatcgggcaaaaagtgattctttagagaagtagcaacttttcaatgaacatgctaaaataaggaagatgtttaatgtgaaaggactctttcttgtgaataaagaattaatgatcaagcaatttccagaaattgcgttactaaaagatgaagctttattgaattatacgtatacgaaaacaggagggcctgcagatatcctggcttttcccaaatcagcaaaagaagtagaacaaattgtcgcctattgtcgagaaactgatactccttggttggtcttaggcaatgctagcaacttgatcgttcgtgatggtgggattcgcggtgttgtgatcatgctatcagaaatgaatcagataacggtagaagataccactttgatcgtcgaagcaggcgcgaagctgatcgatacaacgtatgtggcactccatgaatcgttgacaggatttgagtttgcttgcgggattccaggaagcgtcgggggagcggtatttatgaatgccggtgcttatgatggtgagattcaagatatttttgcgtcctgtgatgtcttgctcgcagatggacgcgtcgtgactatgatgaaagaagagatggcgttttcttatcgccacagtacgcttcaagaccaacatgcgatcattctgtcggctcgttttgatttggcgcaaggggatcaagatcaaatcaagaaacgaatggatgagttgacggaactccgtcagctgaaacaaccattagaatatccttcttgcggcagtgtcttcaagcggcctgttggtcatttcactggcaagttgattcaagacgccggtttacaaggattgaaatggggcggcgcgcaaatttctgaaaagcatgctggcttcatcgtcaatgtcgatcatgctacagcgacggactatgtggaactgatcgctcatatccaacaagtgatcaaggagcgatttgatgtccagttagagacagaagtgcgtattatcggagaagaagcaaaataattaaacatgttcgtaattgtgacaacgtctgatgacaaatcgatatctgaagaatgaatgtattgcaaggcttcgtaaggcatcgttgcgatgtatcgagaacctatagcattacttgaatctttcagaacggttgtttatttggacagttgtcacattttttattaaaaaaggcaatgggaaggctgtactatttgtctacccattccgtcttggctacaataaagaaaaggggaaaatggagggatagtatgaaaaagtggttgggtattggcttgttggttgggctattctttttaaccggttgtacgaaattaccgcaggatcagtttgctgatgggttaacagtacaaaaagatatgaatgctggtgactttagcgtgacgatcgatacatttgaatttgctggcgaggacagccaaaattcacaagcaagcatgatcgcagggatgattttctcccagttggcgggaaccaagatcacaggaaattttgttgaagatccaaaaagcaaaaatattcgtttggatgcctcactgtcttctggagaaatcgatgttccactgaatcttttgatcgatggcaagagccatgacacctacctttcagcagaaatcgttgaggcaatgagcaatctgtttgcatttgatacattcggtacatcggatacgtttgcatcggatacatttgatagtagcgaaacgccagatacgacggggaaagataaatatattcgtctgtcaccagatgagatgtcagatcttgacacggaccagctattgaacaatagcttattttcttctgagacattggcagagtatgtcaaaacgttggatcgtgaatcttttaaaagagatggtgacaccatcacgcatacattcacaaaacaagagctgttggactttgttgactatgccaaaaaacaaaaggcagacactagtgagattacgcagtgggaagatctgctgaaagacagtgagcgtattgatttgactgtatctgtcaatgcaaagaaacaaaaccaaaaagttgtgatgaacatgacccaatctggcgagctgcctttggctattgggatcacgtttactatcagcggcaaacaaagtgatgaaaaagtccagttacctgcttcagaaaatgtcgttgatcagcaagagttttttgattcctaccaagaagactctttttgggatgacagttattacggcgatgatcccctctctgatgaagattggacaaattatacgctaacagacgaggagtttgaccaattattagagatggttgccactgatctacagggcatgacggatgaagaaatcgttgattttttgttgatttatgaagacttactgaccgaagaacagtaccagcgtttggctgaggcattgcaagtaagccaaaatttatgagcagcataaaggaacactaaaaaaagagccattgaagcaagcttatcaagctgcttcaatggctctttttatttgaagttctttcaaatgaatcaaaaacgtggctttttcgtcaatctcagtaatacagaagcaacagccatggtcgcaattcctgcaacgatcgcctctgggataccttgtgtcaaaataacgccaaggatggcggtatagacggcagttccggcattaccgatcgcagcggcatattcttgttggaataaaaagtagatgaggttcatcacgagaatcgtattcgtcaatcctccagcgattccagcaatcagcaacgaagtgctttgccgcttgttttgccacattttctggcaggctttaaagacaaaataagggacgattccgatcagaatgcgaggaatcagagcaaccaagatcgctttccaacttccatgatccatgccatagactgggacaaatggcgagaacacaaaagaaagcggcgagatgatccacgttgaacggaccatactaatgatgccaaaagcccctcccagaaagccgccgatccgtggtcctaaaatgatggaagcaatgatcacgggaatgtgcatcgtagtagcattgatcggacctaaaggaatgaaccctagaaaaggaacggatgctaaaagaatcaagatccccaggaaaaatgcagttaaaactaaatcaaaagtggctatttttttcatgttagactcctcgtacttccaatgctgcaacagcttgttcaacgatcgcttccacggtcgccagcgcgccgcggccgaaatccccgcaagccaacaaggcttcgcgaggagcgatctcttgataaccgacctctttcaaaatggctagatttcgttgcacgattggattttgatacatattggtattcatcgctggtgcaatcagttttggtacctccgcagtcaatgccaaagcgaccgttgagatcagatcatctgctaaaccatgagccaatttaccaatcaagttggcactggctggcgcgatcaagaaaaggtccgcttgcttcgctaattcgatatggttgatccggtcaggttggcgttcttgcatcacatccacatggattggtcgcttagataatgactggagagtcaatggtgtgatgaattgcgtactattagcagtcatcatcacgtcgactgcataccctcgttttgtcaactcattcgcgatatccgctgctttataagcggagatacttccgctaatacctaataatacatgtttttgtttcattttaattcctccttatccaaggggctcttcatttttcaataatgtatctacgatcaatgcggcaatttctggcttagtatggccggtaccgatttttttatcggcagttagtaagtgaccaatatgctgatcttctttgatcgtagtcaagtcattggccaagacataatctgcttgatttttagctagactatcacgggctacttgaaaaagtgtttcttccgaaacatcgactaataatttgaaacccaccaactttgtctgaggttgttttgctttgattcgctggatcactttaggtgttttctttaagaccatcactagatgatcagtattcgaagagagtttgcctgactgttccattgactgtgctactaatgtctctaacaactcaggagatacttggttgtcaaattgtggaagcagctgattgatcgctgtcaagaatgcttcttgtgaccaactgttagcaggtgtgaaatcactgaccgccatgctgtggatcactgcaaagtaagtatgtgccgataataaggactcaagacaattcagtaatccaagagtgccttcgatagagtggaccgtcaatcgtgaatcgttagctggctgttttgcttgacgagttgtgacataatcaatttcaatccctttttctaataacgcttcagcgatggctttgcctaatgaacctgttgaatgattcgtgatcgaccgtactgaatcaattttttcggaagttccgccggcagtgatcaatattctcatgcttctgatgccaccttgacgatcgtccgaccttgatgggtaccggctaataaggatgcgagtgtttccggcaatgtttcaaaggtaatctcatgactatgcagctgatctgcgacataccagcctgttgctagacgttgccaaagttcgttacgagtggcagtgtcaacattgaccgagtcaataccgatcacgcggatgccgcgaagaataaagggtaaaaccgtcgtttcgatgttgatccccccagcatttccgcataaaaaggcaccgccgccgtaacggatttgcggcaataatgcggaaagaagggaaccaccgacggtatcaataactgccgctactgtctgcttcgccagcggtttgattttttctggttgccaatcagctggatcagtgattttggttgctcctaatgccaataaccagtctgcctcttttttacgagaaagtgcgacgatgtttgtatagcctaacttatgcaacaatgcgatgctgatacttccgacacctccggaagctccggtaatgacgatcggcgcttctttttcaagggcaagtttttcaagttcggtgacagccagtgccgcagtaaagccagcagtaccataacacatactatctttagccgataaagtttctggtcgtttgatcagccaatcagccggtacccgttggtattggctgaagccaccgggatgagaaacacctaggccgtaacctgtcagcagtacttggtcgccggttgaaaaatccggactttgactttcaatgacttcaccagccaagtcgatgcctggtgtcatcggataagtacggataacaccgccattttctttagctgctaaagcatctttataattgacatcggaataagcgactttgacaagaacgtctccctcaggtaaatctgtcagtttgcaggtctttaaagtggcagtaaatgttggttcatttgttacgatataagacgaaaattctgtcattcaaggcaactcctttaatggtttgaactcatgataccataatctggttgatttttaatcattgttgcgaaacagatgattattcatgagacaatttcttcgttagaatgagagaagagcattgagagctactgaatgaaaacggctaaataaaggcattatgtgacagctgctcattggctgcagctcatttagtcaataagaaagcttcgaaaaattctcttcaaaaaaggtaaaaaaagacttgttttttttagaaaagtttgtatactggaaaaagtgaaattaaacttgaagtttactattagcaaacttttttgtgggaattttttactatatttttgatcgagggggaatgtagatggagattggcgagaagctccgcaatttgcgggtccaaaaaaatctgacacaagaagaattaggggaacgaaccgatttatccaaagggtacatctcccaattagaaagggatttaagttcaccttcaatggaaactttttttacgattttagaagtccttggagtgaccccggaagaatttttccgtcaagaaaatgcagaccatcaagtggtctatcgagaagaagacagtacgagttattatgatgaagaaaatggctatgaactgcggtggctgattccagactcgaatgaaaaagagatggagccagtcgtgttgacttttgagaaagccggcgagtataagacatttgaaccttctttagcggaaacatttatttatgttttggaaggaacgattgcactgagcctcggggaatcagaatacaaagcacgtaagggacagtccatttattaccaagcaacagaaccgcatcaattgagaaatatcggccggcaaaaaagtcgcgccttgatcgttgtaactgattcttatttatgatttagggggaaaaagtgtgggaaaaacaattatttcgttcaataacgtggtcaagcgatttgatgacgatgaaaccgtcttgaaaaatgttagttttgatattgaagaagggcgtttttatacgcttttaggtccttcaggatgtgggaaaaccacgatcttacggatcattgccggattttccgaagcaacagaaggcgatgtttactttgatggccagcgtatcaacgatgttccggcaaatcagcgacaagttaatactgtctttcaggactatgcgttgtttccacatatgaacgtgttcgagaatgtggcttttggcttacggatcaagaagctgccgaaagacgaagtcacaaagaaagtcaaagaagcattgcgattggtccaacttccaggttacgaaaatcgtgagatcagtgaaatgtccggtggacagcgtcaacgggtggcgattgcgcgagcgatcgtcaatgagccgaaagttttactcttagatgagcctttgtcagctttagacttgaaattacgaacagacatgcagtacgaattgcgggaactgcagcagcgattaggaattacctttatctttgtgacccacgatcaagaagaagcattagcgatgagtgatgagatcttcgtcatgaataaaggaaagatcattcaaagtgggacaccggtagacatttatgacgagccgatcaatcattttgtggcggactttgtcggcgaaagtaatatcgtgaatggcacgatgatcgatgataatttagtcgagtttgtcggcaaacgcttcgagtgcgtggatggcggtatgcgggcgaatgaacccgttgaaatcgtgatccgcccagaagatctaagtttgaccaccgctgagaaagggaaattgatcgttgaggtagacacgcaattgttccgcggcgtacattatgaaatcatttgttacgatgaacaaggcaatgaatggatggtccattcgactagaaaagccaaagaaggcagcaagatcggtttgttttttgagcctgaagacattcatgtcatgcgtttcaatgaatcagaagaagattttgatgctcgtttagagagctacgaagattaggagggagcacatgacgaaaatgcgtcgtttctatgcaataccctatgtcttttggttattgctatttgttatcgcaccagtattattgatcgtctatcagtcctttttcgatatggatgggaatttttcactggtcaattatcaaagttatttaggttccggcaagtatttgatcatgacattgaactccgtgtggtatgcctttttgatcacattgatcacgctggtcatcagttatcctacggcttactttttgacaaaactacgtcataaagacttatggttactgctgattattttacctacatgggtcaatttgctgttaaaagcctatgcctttattggtatttttggtattcatggcagcgtcaatcattttttggaaatcatgggtgtcggaccaaaacagattttgttcaccgattttagctttttaacggtagcggtctatattgagctgccttttatgatcatgccgattttcaatgcactagaggagatgaatccttcattgattagtgcgagccgtgacttaggagcgaacagctatgagacttttcgccgggtcattctgcctttgtcattgaacggtgtcaaaagcggcgtacaagcagttttcattccttctctttcactcttcatgctgacacgtttgattggaggaaaccgtgtaatcacgttaggaactgcgattgagcagcatttccttgtgacacaaaactggggcatgggttcgacgatcggtgtgattttgattattgctatgttcttagtgatgctcctgacaggtgagaagaaaaaaggaggacaacgaaaatgaaaaaattccgctggtcaaatctttatcttgtcgttgtctttatcctattgtacgtcccaattttttatttgattttttattccttcaatgatggcggtacaatgaatgactttactgggtttacctttgaacattaccagtccgtctttcaagatacacgtctgatgatcattgtattgaatacctttatgctggcatttttatccgcccttttagcaacagtgatcggcacgttcggtgcgatggggatctactatacgaaaaaacggcgaacacgaacagcgttgttaagtttgaacaatgtcttactggtttctccagatgtcatcattggtgccagttttctgattttcttcacgatgatcggaaatttgttccgcggctttagcctaggtttttttagtgtgttactgtctcatgtggcctttagtattcccatcgttgttttgatggttttaccaaagctacaagaaatgaatgattccatgattgatgccgctcgtgacttaggtgccaataatctgcaagtcatcaagaacattattttgccgtttctgacaccgggagtcattgccggctatttcatggctttcacttattcactggatgattttgctgtgacgttctttgtaacagggaatggctttagcacactttctgtagaaatctattctcgtgcccgtcaggggatcagcctagaaatcaatgccttgagcacattggtctttttattctcaatgattctagtcgtagggtactactttatcagcaaagaaaatgtgtcgaaaaaactacgtaaaaatcggcgagcggaggtggcaaatctgcgatgaaaagattacaatctttgatcataggaattgtcgccatcattttggtactgctgtttggtgtacgggagttggaacattcttcaggaatggcgggcgccaaagttttgaatatctataactggggtgattatatcgatccagatcttttgaagaagtttgagaacgagaccggttataaggtcaattatgaaaccttcgattccaatgaagcgatgtttacgaaaattcagcaaggaggaacgtcctatgacattgccatcccaagtgaatatatgatccaaaaaatgatggaagagcacttgctgaaacctcttgatcacagcaagatcaaagggctagacaatattgatccccgctttttggatttaagttttgatcctgacaaccgctattcgatcccatatttttgggggactcttggtatcgtctataatgataaattttttgctgaaggtgaaatcaaggaatgggatgatctgtggaaaccagaactaaaagacagtatcatgctgatcgatggcgcgcgggaagtcatcggtctagggttaaacagtttggggtattcattgaacagcaaagacgacaaacagcttacagcagccttcaacaaattgcgcaaaatgacgccaaacatcaaagcaatcgtagcagacgaaatcaaaatgtatatggcaaacgaagaagcctctgtcgctgtcactttctcgggagaagcagccgatatgatgtatgagaatgaacatatccattatgtgatcccatccgaaggatccaatctttggtttgataatatggttattcccaaaacgtcaaaaaatgaagaaggggcctatgcatttttgaactttatgcttgaaccagaaaatgctgcccaaaatgctgagtatatcggttattccacaccaaacaaaaaagcactcgcgttattgccagatgaaatcacgcaagacaaacagttctatccttcagatgagctgatgaagcatttggaagtctatgaaaatctaggcgcccaatatttaggcatttataatgacctatttttggagttgaagatgtacaggagataatggtaaaactcagtaagaatggggatttatcaacgttctaaagagctaaaaatcgtcctttttctatctgagttttccaattttctaccaaaagcggctgaaaagccgctttttttgtgttattttattttttctaccacgtttttctaccagagatactttgctagaaaagctttgcgatagagatttttaccagacgatgttgaaaataaaaagacagaaacgcttgaccgtatatagacgttcatctatattgtatatagataattatctatatacaattcaataggaggtcctccatggaaaactatgaacagattgctaccatcatgagagccttagctgatccaaaaaggctgaaaattgttgacttactttctacagctgactctctttgtgcatgtgaagtgttggagcattttgactttactcaaccgacattatcacaccacatgaagcttttagagaaggcaggaattgtcaaagtaacgaaaaaaagtcaatggcatcattacgctttacaggaagattttgttgaggatttcctagtaattttgaaggaacttcttatcaaagaaaaatcaattagctagtaaacgataggagtcttatgaatgaacaatgtatctacggaagtaactgaaaaacctgcaataaattttttcgagaagtatctaacagtttgggtattgttatgtatggcagcaggcatgctaatcggaaagtttttacctagtgtcgcagaccgattagaaagctatcaagtattaaatacaaatattccaattgccgttttaacttgggttatgattttcccaatgatgatgaaaatcgattttaaatcaatactgaacgtccgaaaaacatatcaggggattatgatctctagcattacaagctggctaattaagccgttcttgatgtttggcttagcctctttcttcttttatgttgtttttagcaattttatcccagcagacttagcaaaagactatgtggctggagcggttttgttaggggcagcgccatgtaccgctatggtatttgtttggtcaaaccttacaaaaggtgatccagcacataccttggttcaagtatcaattaacgatttattaatcattgtcctatttgtaccaattgtttctttccttttaggagtaaataatgtgtttgtaccatggaatattctctttgcttctgtactactatttgtgctagtaccgttagttggtggggcattgacgagatacttcatgataaaacgtaagggaattgattactttaacaatcgcttcttaccaaagtttgactccattacaacgattggcttgttattgacattggtaatcatttttacttatcagggggatattattttaaacaatccgtttcacgttctcatgattgccgtgcctttagtcttacaaaatattattaccgcaaactttgcttattttacttgtaaatggacaaaacagcctcataatgtggcagctccagcagctttgattggtgcttcagacttttttgagttatcggttgccgtagcaattacgcttttcggtgtcaattcaccagttgtgctagtgacaacagttggtgttctgacagaagtgcctgttatgttgttattagtaaaattgatcaatggaacgaaagattggttcccgacaaaaggagaaaatgaatgaaaaaaatctatttcttatgtacgggcaattcctgtcgaagccaaatagcggaaggatttgctaaaaaatacttagatgattcttgggagattcgaagtgctggcgttgaaactcacggcttgaatcctagagcggtggctgtaatggaagaatctggaatcgatatttcgaatcaaacatctgacttgattgatttggactactttaatcagtccgatatgattattactctttgcggtgacgcagcagataagtgtcccatgatttcaaaggaaagcacacaccttcattgggatttagtagaccctgccaaagcgaaaggatctgaggcagaaattagaagtgcctttcgaaacacaagagatgaaatcaaaaagagaatgattgaattatcgcagcagttaaatgtgtaattcaaaaagggagcggggtaaggtatgtggacttggattagcgaccaattactaaaaatggtttggctaaatgatttgatggggaaattaattgagcgttttgggctttcgctagacatgttgcatttctaattgagcagaatattcaaccgctatctattcaagaacgattgggccatgcgaatattcaaattactttaggaacttacggtcacttatatgcaaagtcagatcaacaagtagttaacgcgattgataatgttcaagagggcgctattctttcgaaaaatgacgatttattgccagtctgagttttccactacgctaccagaagacagacaaatgctttcgtaccagtgtttttggttgagttgctcctgttgaagatgtatcgaaagtaagcatgcagctgattgactgatacaagggaaggaagcaagtttcaaaaatatctttccccattatgttttaaaatagttacagcttcctagcgacctgtagagagacagcaaaagtctttgtctacaggtttttttgtcttagaaaagagtcgctgagacaattggaagcagctgccctgcagaagaaatactaagcagtactaggtcgaaacaagaaatagtcccaaacaaagcgctatcctataaaaactaaaaatacaatgcgtcagttacagtaactttttttgaaaagggtcatgggtttatagccgtagtttttagaatgaatcagctaattcgaagataataatatggaatttttctagaaattatcgcatgaaatgacccttgattgagaacgccatgaaaggtgggagaaatgcagttgtgtatataagcgaaagctgtctcttctttccaaagaagactggatgattttggaatctgattttctttggcttaaagggtaaaatagtttgtttttttgggagattaaatttatactaatttttatagctaatttagtgacttgttaagtagatacgaaacaactcctgaattagaaaacaaatgaatgggaaagcgaatgtttgatgacagctatcattcgctttgctgaaccgtttgcctaaggagtggaatgttgtgccagatttagtaaagtttgtattggttatcttagttatttgggttatttatcaattggttacttctgttttatttagcttgtcgcaaaaagccgttaaaaaacgactgaagagtaataagatgacagatcaacaacttgtaaacttgtatcattctgttgcaaagtcaaatcaatataatacgatgcaagccatattttcttatggaattttttacaaaagtcatgaaaaacaaagtaatgaagtgtacaagttgtatcgagatgaaatggaaaaaagaaacttgctataaaagaaattttaaggtcacttatttttctgataagtaacatcaaacatagatatggctaaaaatagatccttctttgcaattttgtgaggagggctctatttttttgagcaaacaaaataaataggtgaataaaaagggactctttttttgatggaacatcgtctctgcgtttctactggtaatagtagtgtaacagtagaatttttaaagagtctagctagatatgcaatgctgcttatcaaagacaggatttcataaaaatctatgaatctagtttgtttaggggtattataaatatagcaacaaagtggataaacaatctggaggaggaagcatgattcaacaatttttgcaaaaatttacacgaaaaactgggaaagtagaacaatcattcgaagtagtatctaaagaacacagagaaataaaagggctttcttttgaacaaaacgaagatgaatcgatcgttatggactttttgaatcatatggacagagagtatgacacaacacctgcaggacggaaacagcaaggggatgcctttgagcaatttttggcagcggtctttcggctagcaaactacgatgttgagatcaccagaaaaagctatctgcaaggcaaacaggtctacactggtgatgacaatgtagacttgattttaagcaaagatgcggaacggattgctgttcaagccaaacattaccgcttgaacacgaaagcacccaacttgatcacgaaagagtttgtcaataaatattcaggaatctcagataaaaattggacaaataaactttttatcacaacatctttatttaatccccatgtttatttagagatcgagaagaatgaaaaagcacaaaacattgaatggtatgacaggtacgggttattgcagttgttgaacacattgatcccagaaacaatggaaaagcacatgtttttaaatagtttgccagaacaagtagtcaaatgtccggaatgtgaatcagggtttattgtccaaaaatggaataagcaaaaacatagctatttcaaaggatgtacgatgtttccagagtgtgcccatacggaaagtgtttcattcaggcacacacgtaaaagttttactacgtcctcaaaagaactagataatagcatttcttcttaggataactggtactctaaaaagctcatttgttgaacgaatcagacacttagtagaagaaaggaatgaaaagatgtttaatctcgctgttcgtggccacgacttaaccaaggtttgtgatccacaagatctcgcttgtcaaatcgctgaaaaaggcatcaaaaatgttcaatttgcactaaatgcttcatttccggaacttagtgctgctgcccagatcaatccgggaatggggactttttttaaaaatgaatttgggcaacagaatgttcaagtggcattgttgagctgctatagtaatttgattcatccagatcctcatgaacgagaaaagattctgcagaaatttgaacgctatctttttcatgcacgctattttggggcgtcaatggttgcttcggaaacgggttccgttattcccacacttggttacagtgaagaaaatttcacagatgaagtttttgatgagcttgtaactgttgtccagcggttggtaaaaaccggggaacgttatcaaacaatggttgggatcgaagcgggattaaatcaccccctattttccaatgaccgaattcaggaattgatcgcaagagttccttctgattttctgggcatcgtctatgaccctaccaatctcatcactccagaaacggcaagtaaacaagtagaaatcgttgcagaggcctttgagaagtttggtgaacgaattgtctgtctccacttgaaagactacgtgattgaagaggaccgcattgtttctgtccctttaggagaaggaatcattccttatcaagccattttacaaatcgttgaccaatacaaaccttattgctatgtcgtattggagggaacaaaagacgaagaaatcaaacgggcggttgctatgatagaggggctaagctgaatcgaatgaacccattggcaaaaaaatcatttgacgtcaaagaagtgattgcctctaatcgcgaacacatttagagagcacgcttatttaaaagaagcgacagcataagttagaatgggacaaacagacactagcgcataatcctgccaatattctgaattaacgctcaaaatatgcgatgaggatgtttgtgttctgtcccgttaaacgttaatctgtcgcttctttttttgttgggaatgatacgttctaattgaggctgttttattcgttgatctgccaatgacgaatcctatggatcagctgttctttctctttttcactggcaaaggaatggcgggcggcggtctcattcaataagcgcagctcactttccgacatttggcagtgacgggtcatgtgtatgtattcatcagtcaatgttgttttagaaacggtgcggttatctgtgtttaagcaaaaagggaccccagctgtcagccattccctgaaaggatattggtgataatccgtgatggctttggtatgcacattactagtaggacaaccttcaatacagatttgattgcgggagacaaaatcttgggctttcttatcccctttcaaaatgataccgtggccaatgcgttttgcaccactttcgattgcttgatagacattacggatacagccgcattcaccggcatgcaatgtcaattgcacgttttgaccgtctatgaaaagttggtaagtttgcgctaatttgggaacatagtcatcttcttcaggaccagctaaatcgatgcccacaactttctcttcagaaacagactccgaaaaaatctgggagattgcagcagcagactcttgccgcatcccgatgatcaagatattcccttttaccggatagatggactccgcacgagcgatccctctagctactgcttgaatcgtttgtgggcaggaaagaccctgttccattgactgactaggagcaaagcggatttcgatatacgcgacaccatcttcaaacgcttgttccatgacatcaaacgctgcggcttctaatgcaaattcactttggagataaggaagaacgaaatcaaagcgttccaagtactcattaagatcagaacagtcttggggggcttgcatccgttcttcaaggatcgacagttcttgtgggataggcagattttgctgattggcgatcttaagtaatgtttctggacgaatcgatccatccaaatggcagtgcaattctactttagggaaggcttggatttggcttttcgttaacacgtcattcctcctcgcatacgcagggtacgctgaatttttttatgtatgaatatagcatagatacgggttatgtgctagtgaaaaaaggaaattctcatgataaacactctccctctcaaaaaagcttctataaaaagcctctataaaaagcctctataaaaagcctctataaaaagcctctataaaaagcctctataaaaagcctctataaaaaagctccggtcaaaaaagctcgtatcaaaaaagccgctgccatgggaggattgtcccatggcagcgtacgattttgttgagttggcactttttttgctgagaaaactaaatcagctctgagagttcgacggcatcgatcgccagatcttgtgcggcttccttcaacgtgaagtgaccgtcaaatgcgatgacaccacgcgccagtgcagcgtttgttcttaatgccttttcaggatcggcagccaattgtttagcgtagggtaatgtggcgatactcaatgccaatgtagcagtctgtggaactgcgccaggcatattggcaacagcataatggatcacattttcttggatgtaggtaggatcgtcatgagtagtgacacgatcttctgtctcaaaaatgcctccttgatcaatcgcaatatctacaatcactgatttttctgccatggttttcaccatctcacgagttactagatttggcgcttttttgcctggcagcaagacggcgccaatcaccaagtctgcttgttgaatagcggcttcaatgttgaaacgattagagaagagtgtctgaacttgtccgtcaaatagctggtctaattcttgtaagcgtgggatggatacatcgagaatcgtgacttgcgtcccaagccctaacgccattttcgcggcattggttccggcaacgccaccaccaataatcgtgacctgaccttttcgaacacccgggacaccggacaggaggactcctttgccgccatagattttttctaagaattgtgcgccgatctgaactgccattcgaccagcaatttcactcattggagagaggagaggcagcgtcccattagccagttggacattctcatagccaatcgctcgaaccttggagaacatgagcgcttttgctaattctggattggcagcaacatgtaggtaagtaaataacagcaatcccgctcttaagtaggaatactcttctggcagcggatctttgactttcatcaccatgtcagccgcccagacgtctgcagcgttagcaacgatcgttgcgccgactgctcgataggcttcgtctgaaaaagttgatccgatacctgcatttgcttcaaccaagacctcgtgcccttcttgaaccaattcatagacgccagctggcggcaaagctacacgattttcattgttcttgatttctttaggaattccgattttcatatgcgtcacacctttctttcttctattataaaggaaagcggatccattgtaaggagaaagcgaagatttctcaaggtagccgtcaagaggcgcggtcattatcaacatgcattgatgaggactatttataaaaaaactacctatagagtgtcaagaaagaggtaatcgtgcttgatccttcctgacaacttataggtagtttcttttttataaattagtactttcgtcctctgtaaatgtccaaaaatgtaaactttgagcagcgatttcttccaatgaataggacgttaaataatgttttttttccggcgtatcgtttggatctaaaacaaccacattttcgtcttgcatagcagccaacaccatgatatgaccagtatctgtgaaatctccactggtcacagagacgatcactggctgtccaactgccagataattggctacttgcgctgtgtctgtgcccaaatcgtgatacgagtaaccaaaggaatccgcaaaatcagagaaaatccgccaatcggttccttgcccatcgacatagtagctatcttgtgcccaatccaaaacttcaagcggcgaaacattatcctctcgcaaataagcgagtaccattgaaagagagagcagggcacagccattatcgcttaaagtttgcgtaccatctgaaccataggaataatcagcccattcttcatttgtttgtaggtaaagaggcgtagtcactccattttcttgtaaatactcgttcgcttgttcattgtaagctgcttgatcaaaatccatgtcatccatcatgggatattcttcataatcttggctggaatagctcacatgagaaagtcggataaatgcagcaaaaatcaataataaacccaacaaaacaagaaaaacataacgctttctttgtttcccttttttcttcatagcttccctcctgaagtagcgtgccttttttgccttacttcaagtaaagcagagggaatgaaggttgtcatccgcctgtggactgattcgtgtcggttgtttctagttcttccaattccagactcgtgttttcccaagcttccatcagctgttcttgggtggcttggacagtctccattgcttgattcagcgaagacaaacggacgtggtcgttcaatgcgtcaggacgagtcatcgcttgttcgatttcttcaagctctgcttcggttttggctaggtctgcttcaatttgagtgactttacgctgcaatgagcgaatggctttttgttgttctttgctctggaagaaagattgtttgccttgtgagatggctttctcttgaacatcagattgctgcatcgcagctagttctgtttcttccagttttttctccacgtaataatcatagtcccctaaatacaatttgctgccggtttcagataattcaatgactttggtcgcgattcgattgataaagtagcggtcatgagaaacaaaaagcaatgtgccttcataatcaatcaaggcattttcgagtacttctttgctgtcgatgtccaagtggttagtcggttcatctaagatcaggaagttgtcatgatccatcgcaagttttgctaaagcgacccgtgccttttcgccgccactgagcaatgtgattggtttttcaacatcttcaccagaaaaaaggaaacttcctaaaattgtgcggatctctacttctggcgtagtggggtgctcatcccataattctttcaagattgtttttgttgaatggagatctgattgggtttgatcataatacccaattgagacattggcacctagatgaacgtcaccgcgaatcaaaggaatcttgtggatcagtgattttaataatgtcgatttgccaattccattagggccgactaatgcaatggcatctttccggcgaacatccaaatcgatcagctcggatagaacagtctcttgataaccgatggctgcgttggctacttgcattaccacattgccagaaggtttactgattgaaaaaaggaaatttgcggatttttcatctccttgaggccgatcgagccgctccattttttctaattgtttgcgccggctttgcgcccgtttagttgtggaggcacgaactaaattacgcgctacaaagtcttctaatttattgatttcttcttgttgtttttcgaaagctttccattcactttgcagctgctcggctttcaaaaccagataacgactgtaattccctttgtaatggtgcattttccgtcggctaagctcatagacctcattgacgactttatctaagaaataacggtcatgagatacaatcaaaagagcaccggcatacccttgaagatagttttcaagccaagacaatgtctcaatatccaggtggttagtcggttcatccaaaatcaaaatatctggcttttgcaacagcatctttgctagtgctagacgagttttttgaccaccagacaatgtttcaatggattgctcataaaaagtgccgtcgaacttaaagccgtgtagaacagaacggatctcattttcatatccgtagccgtttttttcggcaaattcatgttgtagctggtcatattcttttaatagaccatcataattgactgctgtcgggtctgtttctgaaatggcgacttctaatgagcgcatccgctgttccatctgtcgaatgccggcaaaagccgtcaacatttcttcccagactgtagcagtactgtttaaaccagtgtcttgggcaagataacctagtgtcgcagttttatttttggcgatcgttcctttatcggggctttcgatcccggcaatgatttttaacagggtcgattttccggcgccatttcttcccacaagcgcgatccgggaatggctagcaatctctaggttgatattctcaaataaaacttcagcgccaaatagtctggcgatttgatttgcttgtaatagtatcatatgtattcattcctattcttgaagtcacttgtctccttggttgcaatactatcagtctatcacattttgtgataaacagcgattatgaaaaaagaatgattgtatcattaaacaaaaaaaatttcaaattgtgagcaatcaaattgatttttgagcaaactatttgatatgatagctacatcacacgtgaatttttcacaatgggggagtatttcttgaaagatcatcaaattccaaaggcaacagcgaaacgtttgcctttgtattaccgctatttacgcatcttgcacaatgctggaaagttgaaggtttcatctactgaattaagcgaagctgtccaagtggatagcgcaacgattcgtcgcgacttctcttattttggggaattgggaaaacgcggctatggctatgacgtggaaagcctgatgcagttttttgctaaaacgttgaatgaagaccatatgacaaatgtcgcgctagtaggtgttggtaatctaggtagcgcactgttaaaatataaattccatcagagcaatagcattcggatcagtgctgcatttgatgtgaatgaagatatcgtaggacgaatcgtggatggcgttcctgtctatccaatgagcgatatgaaagaacaagtgaagatccaacagatcgatgtcgcgatcttgacggttcccgcacaacattcgcaagacttagtcaatgagcttgtgaaagcagggatcaaaggaatcttgaactttacgcctgcgcgcatcactgcaccaaaaggtgtgctgatccaaaatgttgatttgaccaatgaattacaaacactgatttatttcttgcattctggcaacgtcttaacgacagatcaaccggaaaaccacgaaacgactgaatcagaataaaacccaaaaacactgtctttccatcaaccttcgcgtctagtaggtgatggaaagacagtgtttttttattccatcagttgatcaaaaagatcgtcataagagatggtctcggttttggtcaaggcagtcctatagcgatcaataatagcagccagcctattaaaatcaatgattcgtgcttctctgtggcgttcatctccttgaaaataaagaaggacgacaggagcagtcaatgctgaaaattggccagccgcctctgggacttccgctacattgacagcataaagtggaacatgcttttctaaagctaatttattaagacgaggtttgtctgctaagcagacactgcaagccggctgtgagagataaataagtgccaatggggtttcttttatcttcgtcagcagttcatctaatgtattcatttgtatcatgcaaattcctccaagcagattctctgtctaatgtacgttttgagggacaacttgtcaaagaaactgctggaaaagaataaaaactaaagcaagctttaaggtgccagcaaagactgtaaaaaacattgtgcattgaggcaaaaaaacgtatagtagttccagcgcaattatttttttataaagaaggttgaatatatgttacaaagcttacctaattctgttttgcagatgagcgtgatctttctctccatcgtcattgaagccttgccttttgtcttattaggctgcttgatttcaggggcgctgcaagtttttctgacgccagaacgagtgacaaaaatcctgccaaagaataaattggcctccattgcaatggggtgtggtttaggcgttttcttcccgtcttgtgaatgtggaatcgttccgatcgtcaatcaattcgtcaaaaaagacgtaccagtctacacggcttttgcttttatgctgacagcccctattgtgaatcccattgtaattttttcgacattcatcgcatttggcaattcagcgaagtttgcctttttgcgagtacttggcagcttgttggtggcaatggcggtaggtgtttggctggcttatttcagtaagcgagagattttgaaaacccaattgatcacagcttcagaggatacccatcaaggacattaccatgggcatgctcatgatacaggttctgagaaacgaaaatggtcccatcaaatacggcatttgttgcaacacagtattgatgaattcttcgatactggtcggtatttgatcattggcggattgattgcagcagcgatgcagacgtatttgccaacgggaatgatgttgactttgggttctacgaaattcttggcggtattggtcatgcttgttttggcattgacgatgtcgctgtgctctgaagcagatgcgtttatcggttcttcgctgcttagtctgttcggcgccggtccagtcgtgggttttctggtctttggtcctatggtggacatcaagaatcttctgatgatgaaacgatattttaccggtcgttttattgcaacaatggtgggattaattgctgttgtagtctcaatttatgcatgggtggtgtaaacaatgatccgttttttgattttatctggatattttgagttgatgatgtacttgcaggtatcaggaaaactgaatcagttcatcaatgtccactatcgttatctagcgattctttcgatgattgtcgctttatttttggcattagtccagttgtatttttgggtcaaacaaacgcctgatgaacatgaagatgagcatcaccatggactcgaaaaaaaatctcagcgcctcattgcgtatttcttattagcattgccaatcattgttggtttgtttttcccaacagtcagtctggatacgaccattgttgaagcaaaagggtttaatttcccgctgagtgaagagtctgtcggcgatcccgaaatgaatacccaataccttaaaccagatactagtctttattacaataaagatgattatgacgagcaaatgacgacttcgttagcgaagtatgccgataaacaaacgattgctgtcaccgacgagaattatttggaactcatggaattgatctatacgtatccaagtgaatttatcgggaaaaaaatcagctatgacggttttgtttatcatgcagcgcaagatgatcgtaatgaaatctttctgtttcgttttgggatcattcactgtgtagcggattcaggtgtttttggattacgtgttgagttacctgaacaaacggttaccgagaatgaccaatggctgcacattgaaggaaccatccagtcgcaatactatcaaccctttaaacgagatttgccaatggtagtcgttgaccaagaacaaaccatcgaggcaccggctaaccaatatgtttatcgatcattctagcgaaatgagagaaatgtcggtttttttgaaaaagttcacaaaaatatcataaagctttgttataataaagataaactagtgcagatgtttgtagttttacaaaacgtcgagtacaatagaaacgtacaatgtgctaaaaaacaatataaagagaggtgtcgtgaaatgggttttacagatgaaacagtacggtttgattttgatgatagccgcaagaaagaaatcagtgaaacactggctatcgtgtatcgtgcattagaagaaaaaggttataatccaatcaatcaaatcgtcggttatctcctttctggcgacccggcttacattcctcgttatcgggatgcccggaacttgattcgtcgtcatgaacgcgatgagattttggaagttttgattcgttattacttaggaaatcacgggatcaacctataatgagagtcatgggtttagatgtcggttcacgaacagttggtgtagctgttagtgatcctatgggatggactgcgcaagggatcgagatcattcgaatcaacgaagatgaaaatgactttggctatgatcgtcttggagaattagtcaaagagtatgaagtgactcgttttgtggtgggactgcccaagaatatgaataacaccattggtccaagagcagaggcttcactagcttacggcaaggccatcgaagaacgttttgatttgcctgttgactaccaagacgaacgcttgacgactgttcaagcagaacgaatgctagttgaacaagccaacacatctcgtgccaaacgtaagaaagtcattgacaaattagcagcagtaatgattttgcagaattatttagatggtgctggaaaacaactgttttagtttacagaaaagaggaaaaaaaatgtcagaacatacgcatgatcacaatcatgatcacaaccacgaccatgaaggtcacgaacacattacattggtcgatgatcaaggcaatgaaacattatacgaaattcttttgacagtagatggacaagaagaatttggacgcaactacgtgttgctttatccagctggagtcccagaagaagaagatgtcgaattacaagcctatgcctacgttgaaaacgaagatggtacagaaggcgaattagaacaaattgaaacagaagctgaatgggacatgatcgaagaagtctttaacacattcatggctgaagaagaatctgaataaagaattgatggctgaacctttgatagtcaagggttcagcttttttatctaaaaaaccgtcagaaatgaaatagctcatttctgatggttttttttttgaattttaccacagccagttttacataaatcagttaactagaaaacaaagtttgtagtttttgatgatggacttctagaaggcgttgatataaatcagtttcgaaatcactgtaatggcaataatcaaggaccgtatatttaaaaggatctaggcccttcggaatcagcaaaggtgaccccaagatgataaagtcatattcttcagtgattggaagtgtcagctgttcgatagcaacaaatgggatctttttgcctaggtttaagatctcagcggaaatcagatgctcagaaacattgacaaaaccaactttcaacttatagttttcgtcgatttctgaataatacggataaagcaaacaagcttggatgaaagctaattcacttacacaagatttcagccacgtataatttttccgttgggaaaattttttccagaagccttcgattttgattgtcaagatatgtaagagtgggtacttttctttgatatacgaagaaataaacaatgtggtcaaagggattttttgtttgaacaagctaaagttaccaatcgataggtagatgttcaaatatagagctggctcattttcaaaatgaaacgtaccgataaacgtctgacaatggtcttggaattcgtccaaaatctccttggggtcattacttggttgctgataagaatgttggatgatcggcagacgaatgtcttggttggaagtcagaaacggccaataataaaacaaatagaacaaagagtttacctccaagaggtctaaacgcagattggcgatcttgaagaaatcgtaaaagaagttgaggtctgtaccacttggaatgaaagaatcccttgataagtgatagatatcagtaaagtggctgtttttgatcctcagcaaacaaatcagacaatggagactggcttgtttttttcctaagtcaaacttgttcttatgctgtgcttcttcatgtttataaatcaatgctctcacttcttggctataaggaactatgtccaaactttcacctaatgatacaaaccaaaagaaattaaaaaagaggatacgaatcaacatttcggaacctgacaaggtcagattcgataaattcaagttgatattgtattccttcaaatattcaaccagcttttttgtttgacgaaaacaggtcgagcgactgatatagtgccggttacaaaaagcagcgagatcgtcgtcctcttctattagcatactgagcaacaatttataaggaacactttcagttgaaaggtaatgttggtattgggtgtattgaacaagttgttcattgacggttaacttatttttactatgtaatagcttgatggtagtaaatttttctaaatcatcttggattgcgctcaagatttttttgaagcgtgcagggccgtaataaaaatccaagttttcccgcacctgatctatgctgtattccccgggtgagagtgtcatcaacttgccgtagacactcaatttcgttctggcatgatcatctaacaaaattttttcaatcaattgatcaccttcctttttttgtaattattattattagcgtatttaatttctcttgtaaatacgtgtctcagatttctaacaagtctatacaaggtttagaaatatttctatttcacttgtctcaaaaatagcgttcagcgagtatgttttttgagagaaaagaaataacccacaattttaaataacgatatcaatattttttttgcttccttgttagtgtgtttaatggatataaataactataattgaatatttagaagctgaaggggaaagaattagaaatattagtgaatcttttctttttttttattatctatttgaattttaaaaaaatttcgaaggaggcactaaaaatgaaaaagggaaagcatcttgtccttcttagtttgttggccatctttttcatcgcttacttatattctcaacacataaacaaggtagtagcaaatgatgaagatgttgttgatgtagtagaggtgttgaaaaatgattatggagaagtgagtatcaagcaaacagatgatcatttgatcctcttttatcgcttaaatgagtcaacacaagaaagacgatttttatttcagctgcatgccaaggatgcagctgaaaacaatttgcttacttcttacacttctcaggaataccaagaatatacagatgagaagcaacagaaatacatggacgtcagacaaatcaaaggcgaaacactttgtcagcggcaatcgttatgaaataggagaagaggactttgtcgagagtgctgcggctaaaggacaaatgatcgtcgctggtttagaggtcggagagtatgtattggaggaagtcaaagcgcctgaaaatgctgagatgattgccgaccaaacaactacgctatttaccatcatttcaggaagtcaaatgcctgtagcaaagacggtaaaaaatgatacgactaaagtagaaaaagacacgccccaattagaaggacaagatgtagccatcggtgaagcaatcaactatgagatcactgtcaatatacctgatgggattgccgataaagaggaggagagcaacaagtatacctcattcaaattgatcgatagccacgatcctgcattgacatttatgaatcagtccaagggagaaacaagctatgcactctatgatggtgaacgtctcattgatactaataattatcagatcactgaacatgccaatggttttacagtagcaattgcgcccacatatatcccttccctgactccaggtggaacgttgcgattcgtttattacatgtatttgaatcaactagcagatccgacgaaaggttataaaaacgaagcaaatgtcgataatggtcacacgacagatcaaacaccaccgactgttgaggttctgacagggggaaaaagattcataaaagtagatggggcagtgattgagctacggccattggcaggtgcatcgtttgtcgtacgcgacgaaaattcggcgaccgcgaactatttgatcattgatccagtcacaaaagcagtggcgtggacgaattctccggagaaagcaacaactttcaatacaacgaacgatggattagtagacattacaggattagcttatggaacctactatttggaagaaaccaaagcaccgaatagctatatcaaattaaatgaacgaattgctttcaaagtagatgcacaatcttatgcggtggcgaatgaattggttactccagaaaaagtaccaaacaaacagaaaggaacattaccagcaactggcggcgagggagttactttgtatattggtttaggtgtcgttttattgacgatagtaggtgtctactggataaaaagatataaggcttagtgtcaaacgaagaacgaatggatagctgaggagaatgaaatgaagcaaaaaaaaggcatactttagatctaatcatgctattggtattttttatcggtatcctcagcttggcgtatccctttgttagcgatacattgaatgactatctcgatcaacaaatcatcaaaaactatcagaaaaaagcaaaatctgaacatgcgtcagtgattgctgagttgaacaagcagatgcgtgaagcaaatgaaaaaatggcatcaaatgaacctaagacagaagcagacccattttccaaggaaaaaaaggaaaagcagaactcgctgaaatcttatatagaagcacacacgataggtgttttgacgatcccaaaaatcaatgtcaatttaccaatctttgatcagacgacaacaaaactattggagaaaggggcctgtctgctcgagggaacttcatatccagtcggaggagtatcgacgcatgcggtactttctagtcaccgaggattaccacaagcaaaactctttacagatctacctcggttacagatagaggatcgcttttatatcgaaatcaatggtcaatatcttgcgtatcaaatcgatcaaatacaaactgtcgcgccgacaaaaacagaaacacttcagatccaagataaccaagacctggtcacactagttacttgcaccccttatatgatcaatagtcaccgtttgctggttcgcggacacagggtcgcagttgagcaagaggaaataagcgcgtcattgtcaaaagtgcagcaagcaaaacgaacgacctttttactcgtgactggtttgatcgttgtccttttgatgctgtctttggtgatggtgataaaacattttacaaaagttaaaaatacatgtagttttaaaaactagattcaaaagttttggtaatcagatagtttttcgagtataatggagtcgaagaaatgaaacggagtggatcaagatggagatagaatttagtcgaaagtatcaaatcatcaatgaagtattaaatgcagtgacccatgggatcgcagcgttgttaagtttgttttgctttaatttgctgatggatcgcgcccataccaccttagattatgtcgcttttgcgatttatggaagttcgctttttctgcttttcttttcctctacgttatttcatagcctgatttttacgaaggcaaagaaagttttccaagtattcgatcattgctcgatctatctcttgatcgctggtacgtataccccattttgcctcttagtcgtacagggaatggctgggttgatcttgcttagtgtcatttggaccaccgcagtaatagggattatttacaaatctttgaggttgacaaaaacgaacaaagtatcgaaagtttcaacgatcatctacaatgtgatggggtgggcaatcattgttgtcttacctaagctctatcagaatatcgatttgaccggattactactgttagttgctggaggaatcgcttattctgtaggctcgctcttttatagtatgaaaaatagacgattcacccatgtaatctggcatttgtttgtcatgttaggtgcagcattgatgttttttgcgatttacgtaagtaattaagacgttgtgcatgatgaaataagaatgaacaaattgttgggacataggttcgttacactctcaaaaaaatagaagcactcgaaaatggtttatttttcgagtgcttcttgtttgaaaagggaatgcgaggaaatcctttatgactaaagcaaaaacgtgccgagcaatttagctcagcacgtttttttaccttattcttctactattttagctgatgcaggcaagcagtggttgacggcaatcgcaacggccatcccaatgaaactatcgatcacccggttaaaggcataaagataggattcagtttggggaaccataaataaaatcgtcaaaagggtagcacaggcaccgaccgttccttcgtgatagtcgaatttcactaataatgcgatcatcagcatgataacgaaaggaatcgatagcagctgaacaaggtgtgtgtagccaaaaaatttaaaaattccgatacagatgatcgatgctaatgcgccaaaggtatttccagcaatccgatgccggccgtatttgacagtagtcccatgatcttctcttaaggtaaagacagcggtgatcgttgaaacaacgtatgtctcacgctgtagaagaaaacttagaagaatacaaatgaagacgctgatccccgtttttagatttcgcaaaccaaattttaatccgaatagattcaataatgccatcctttcataagaaatcatcttaaccctttcaaacgaatcatatcataccataagctgtatttgctagtgaaaaaaaagtccgaaaggttgctgcaaaggcttttctttgtgaaaaaccttcgtggctctcctggagaatacgtcaatcagcttgagagtgatcaaaaaagagtgaataccatcgttggagcgaatcagttgcttggctgaccaaacaagcgtaacataatattgtaaacgttatcttattggagagcagggatagggatggaaaaaatttatcaagcaagtacggcagaaggcgcagtcgattttatcaacatgcgtgatttagaagaggcagcaaaagaagtgattcccaaaggaggctatggctacatctctagcggtgcgggagataccttcacttatcgagaaaatgaacgcgcattcaatcataagctgattattcctcatgtcctcaaagacattgaattaccagacaccaggactaatttttccggtgatacattaaatgcaccgattatcatggctccggtggccgctcatggcttggccaatgtcaatgcggagaaagcctcggcaaaaggagttgcgcgcttcggtacaatttacacagctagttcttatgcttcctgtacgctagaagaaattcgggcagccggcggagaacaagcacctcagtggtttcaattctatatgagcaaagatgatggcatcaatcgggatattttggcgatggcgaaacgcaatggtgccaaagcgattgttttaacggcggatgccacagttggtggcaaccgagaaacggatcgccgtaacggctttacctttccattggctatgccaattgtgcaagcttatcagtctggaatcggacaaacaatggatgcggtatatggctcctccaaacaaaaactgagtcctcaagatgtggcgttcattgcgaaggaatctgacttacctgtttatgtcaaaggggttcaatcagaagaagatgtagcacgtgcgttagatgctggagcacaagggatttgggtctcaaatcatggtggccgtcagttagatggtggaccagctgcttttgattctttacagatcgtagcagatgccgtcgctggcagagttccgatcgtctttgacagcggtgttcgccgtgggcagcacgtctttaaagcaatcgcctctggtgctgatctagtggcgattggacgtccagtgatttacggattagcgttaggcggttcaacaggcgttcagcaagtgttcgatttcttcaaaaaagaattagagatggtaatgcaattagcagggactcaaacgattgcagatattcgccaagcgaaactacgggacaatcattatatgtaataaaaaatagtaataaaaagagccttcctctgccgcacgcagccagaaattcaaagaactgaaacctttgaaagccacggcagcggggctttttttatggcttttttgtatctgggttgattataggaaatcaccggtatcaagaacgaactgctacgatttatttgatagtaacagtgtatatgattttgaaaaggagagaaaaccctgtacacttaaattaacgaaatcaaaaaggagagggtaaaatgattccaaaaatcattcattattgctggtttgggggcaatgaattaggggaaagcgaacagaaatatatcgaaacctggcgcaaattttgcccagactatgagatcaaacgctgggatgaatcaacgatcgatctttcaaaatttggttcttacttacaagaagcctacaaacaagaagaatgggcctttgtttctgacgttgttcgtttgtatgcattagtgacagaaggcggcatttatatggataccgatgtcgaagtggtgaaaccattagatgatctattaaactatgaggcatttatgggatttgagatcgaaaccaaaatttccaccggtatcatcggtgcagtgcctcatcatcctttcatggaagaatggtatcatgactatgatgatcgtgaatttgtgcgagcagaaaaaacggaagatgtagtaaccaacgtcattcgagtcactgaattgttgcaggaatatggtctgcaactaaacaatcagcgtcaaacggttaaaggggtagaaattttcccgcaaatgactttctctccaaaaagttatattaccggcgaagttgaggaagatccaactactatggtgatccaccaattttccggatcttggctataaacagttttttactgatccgatagttcgtcaagcagaatcccagcaacagttgaatgggcgcctgctgacgaactattttttattgtctttggcaatgaattatgccacaatagaacgaaatgaaatggatcggagtgagagtttatcatgggaattatccaatgtacaccggctgaccttgttgagttgaaagccatcagtattgagacgtatcaggacacatttgcgccatataatacggaagaaaatatgcaagcttatttagaggctgcttatcattcagaaaagttgcacaaagaactgaaaaatccgcagtctgcttttttctttttgcaagaagaagcaattgctggttatctaaagcttaattggggaacagctcaaactgagccgattgcaccagagggacttgaagttgagcggatctacatccgaagtgactacaaacgccgcggctatggtcagcaattgttgtcttttgcggaagagtttgccaaggcaaaacaaaagacgtctttgtggttaggcgtatgggaacacaatgccaatgcattggctttttataacaagatgggctttcgacgagtaggcagtcattctttcttcatgggggatgatgaacagaccgattatttaatggaaaaacaaatatgaagagagtcactcttcttcgattcgttgttgttgaaaaatcaaagtcgaaaacctgtcgatgagagatgccattagtgacttcgaaagagggagcaagaggaggatgaaaattccttttcaattaatagagcttccagtatagtagtaaatgactaactaaaaaatgaaaattatggtgacagatgaaggagacaagaatgggacaacaaaaaactgaaagtgtattatcacgatttttaaaaggagtcgttattgctttaggatttattttgccgggggtctccggtggagttctagcagcaattttagggatctatgaacgaatgctgcgttttatggcacatttaacgaaaaacttcaaagaaaatctgctctttttcttgccagtagggatcggcgggatcgttgggatcgggcttttatcgaaaccgttagaatggctgctgcaaaattatcagattgtcgtcttatggggatttgccggagccattattggtacattgcctgcacttgcaaaagaatcgactcttaaaagcaaacgaactatgggggatttgttttggttctttggtacaatgatcatcggtttcttatttctttatttcatgggtgatattctaggaacgatcccagcaaactttttaggatttgttttggccggcggattgattgcattaggtgtgttggtgcctggattaagcccatctaacttattgctcgtattaggtttgtatgatccgatgttgaaaggcttcaaggggttcgacattttaggcgtcttcttgccgatcgcaattggtggtctactcgtgatgctgctgttctcaaaattgatggagtggctcttggagcattatcattcgaaagtctatcactttattttgggaattgtgattgcatcaacagtattaatcgtcttgccaccagtggctgattatagcggatttacttggctgactgcggtcagcggtgtgatactgtttgttttagggtactggttaggggcttggatgagtaaattagaagaaaaatataaataaccactgcgtggataaaaaaacaatcggtcagatgatcgattgtttttttatggaatagaaaccgaggcaacctttgtctgaatagcgacgttcacacgtactatcctcactcccccttggaagataatcatgaaacgtcgctggaaaaaggggacaggatcgaacgggacaacttacatctgatcgctaagcgcccaaatttaaaaaaggatatatatataaaagaggtatcggacgatcctgcccaatacctttgtcatagtgaaataagcagaccaaagcgtgttgatttacctaaaaagaggtagaaatcacccagaaaattgggtacaataaacacgttgatgtactgcattgactatggcaaacttgatggtcagttgctgctgacaaatcaaggccctattccttagttgccgctaagggatggggtgccttttttggtttctattcgcttttattttatagaaagcgagggtataaatcaagggaacgtttccatatttaatgaaaaaatgcaagtgttttattagaaaaacgtgaaaagataacagaattctgtgagatttgtcaataaaagtcaatatttatttattgatatgagaaagactgaaaaaataaattttttcctgggagagccaagccatcaaagtgatgatttggctcttttttgtcgcttttttaaggggggcacttacgagtcctttattgtgttaggcgcaaaagtttaccaacttaacatgaacttttcataacgcttactggatgttaacgattgcttgataggatggagtaaatgagtaatgaggtgaaaagatgaatcatgataggctaaaggtacttattgaaaagagactgccccatatccctgcaagggattgtaaacgaaacacctccaaaagcaaacggattttggatcctcaaaaaagtatccggttccaacgtggacttgctaagaaaaagatgctaaatgggctagctataatagtaattaggaaatggcttttgagaatcagcaaagaccgacagatgggggtgacaagctatgtccattaaatcgcaaataaccgaaaagctgcttttactggttttggatggctgccgatacgataccgcggttgaacagatggggatcttgaatcatcatgtggattataaacaagcacaactgatcaaagtccatgctgaaatgcctagcagttctcggccattgtatgaagtgttggctactggtgtaccaagctaccggaatgggattctgaccaatgctgatggtcaacattccaaagaactctcgatttttgatcttgtcaaagctgccggcggaagtactgcagctgcagcacattattggcaaagtgaattattcaatcaagcaccttatgaaatcaaacgagatcgtattcaacacgaccacaaaaaaagtatccaacatggaatcttttatagtgaaaaccagtatcccgattcacatgtgttttcagatggacattatttactgcacacgtatcagccgaatttgttactgatacattccatgaatatcgatgccgcgggacatcgttatacggctgtttcaaaagaataccgaaaagccgtaaaccaagcagaccaattgattggcctgtatttgcacgattggttggctgcaggttatcaagtgattgttactgcggaccacgggatggatgaatatgggttgcatggcggaagcatggctgctcatcgcgaagtccccctctatattttttcagatatttttccgccagactgtgggatcgaaaaaatgaatcaattagagttggcaccactgatttgcagtttattaaaaatcgatacttctgaacgcatgcagattgggcgcagctgatttgtagaaacgaacaaagccgctaaagtcaggtgctcaaattagggcatcattgctagaggtctatttggtttggcttaacgggcataaatagatggcttatatcagatgaataagcaaaaaagtaatcgattgttgttccgctacagagaactgtgccatgagtgaaaataaacggacattgtaaatgagagaaagtggctgccgcgtcttggaaactgtgagagtgcctaggtactatagcagcagttgcgatcgttagaatttattgggttttgtttagatccggtcgttccgtctgtttgttgactgtttatgggaccgtcttttttaattagaacaaggcaacgaagtgctgctattctttgcacttttagacaaacgactttatttgtctaaatctgtgaaaaatagcggttgttatttttgtcacaaatagaagatactgctaccatggatttgtaccaatattaggaggggatcatatgagatatacaaacggaaattatgaagcttttgcaagaagcagaaaaccgaaagatgtcgaaaagaaacaggcctatattgttggtggcggattagctggattagcagcagcagtctttttgattcgtgacggacacatggagggaaagaaaatccatgtgctggaggagctgtctctttcaggcggctcactcgacggcaaatttattcctcatgatggctttgtcactcgaggcggccgtgaaatggaaaatcattttgaatgtttatgggatttattccgttcgattccatcattggaggtagaagatgcttccgtcttagatgaattttattggttggatcatgacgatccaaactcatccaattgtcggatcattcatgatcgtggccaacgagcagcagatgacggagaattcactttatcagcagcagcccaaaaagagttggtccaactatttatgacttcagaagatcagcttgttggcaaacggatcgaggatgtttttggagacgagttctttgaatcaaacttttggctttattggtgtacgatgtttgcttttgaaaaatggcattctgccatcgaaatgcgtagatatgttttaagattcattcaccatatcgatggattgcctgatttcacggctttgaaatttactcgttacaatcaatatgaatcgttagttaaaccattattagcttaccttgatgcacaaggtgtcgatttccaatatgaaaccaaagtcatgaatattgacgtgaagatcactgaaggagagaaaatcgcccaaagtatcacactgatgaaaaatggcaaagcccaagaaatcactttgacagcagatgatctggtgtttgtaacaaacggctcaatcacggagagttcgactgaaggggatcaccatacacctgcccctattactcatgaattaggtggcagttggaatctttggaagaacttggctgctcaatctcctgaatttggtcgcccagaagtcttttatgacaatctgccagcagaaagctggtttgtatcagcgacagtcacatggcaaaactttgatattgaaccttatatttctcgtttgacaaaacggaaattacggacaggaagagtagtgaccggtgggatcgtcactatcaaagattcaaattggctgatgagttttgcgacccatcgtcaacctcatttcaaagagcaaggcgatcaacaaacggtgacttgggtttatggtctattgtctaatacaccaggaaattatatcaaaaaaccgattgaacactgttccggacaagaaatcgttcaagaactattgtatcacttaggtgttccagaagatgaaattctacggatctctaatgaatcatgttcagcgatccctgtgtatatgcctttcatcacttcttacttcatgttgcgggaacctggagatcgtccgcttgtgataccgaatggttcacgaaacttagccttcatcggcaactttgccgaaacgcaacgtgataccgtctttacgactgaatattctgtacgaacggcgatggaagctgtctaccaattgttagctattgaacgaggcgttccagaagtctttgcttccgcctatgatctgcgtacattggccaatgcgatttactatttatcggacaagaaaaaattgactgagatggagctgccatttatcgaacgcaaattagtagaaggatttgttaagaagacgaaagatacctatatcggcgaaatccttgaaaaaaatcatttagtttaacacacttgaatgctgtgacatccgttacttaaagacaggatacccgaaagaaccagagaggccattaaacggcctctcttttcttcgaggttacgtatgtctgacggatggcactgtttttttgggaacgatttccatgctgtagacccccctgtgtgatgtacacaagagtagcgaaaaataagggaaccgctatcaaacaaattgcttctttttaataatacagagtgttattctgttatatttctattgaactttttcactctgtttggtatattggttgttaattaaaagctttttttgcttttagtacagaagctataattgttacgatgaaaggcgggagatttatggaagatgcgacctattgggcagagcaattaacgcagaagaaaatcagtttttcggaattgacagctaggatcgaagaaaaaattcagcaagttgagccaacgttaaatgcgcttgtttcttttgatcggcaagcagcaattaagcagtatgaacaaaatccgcaaacaaaagcggctttattcagcgggctgccaataccacttaaaatattgggtcaaagtaaagcggggtggccggccacatcggcggctgcattgtttgcaaatgcaaaagcagagcagacgagtgcatttgtcaacgggctggaacagctaggattgattcctttgggacaaaccaatgctccggaatttggtttcaaaaatgttaccgatccagtattgtacggtccaacacgcaatccgtggcagtccgcctattcggcagggggatccagcggtggagcggcggccgtcgtagcggctggactatttccattagctgctgctagtgatggaggcggttccattcgtatcccagcttctttcaacggactaattgggttaaaaccgacgcgaggaactatgccagtgggacctcaagaatggcgtagttggcaaggtgcttcgatcaattttgcattgacgctttctatgagagatacggaacgtttgttttatggattacgaacgtctcaaccggcggctccctatcaggcacctagaatcgaatggaaacatcatggacccagtcagaatcgaacactgagagttgcgtacacaaccgagtctccagccgggagtccagtttcacaaactgctgtcttagctgtcaagaaagctgtcgcatttttggaagatcaaggacatcaggttacagaaatccgttatcctgttgacggtcaaacgatgatggcaagctattatcgtatgaatggtggagagacagcagcaatgtttgccgagatcgaggcaatgctgcaacgaccagtggaacagaaagatatggagctgatgacttgggggctgtaccaatatggcaaaaaattagcggctgccgattatatccaggcattgcaatattgggatcagctggcagtaacgatggaagctttgtttgcagattatgagttgtttttgacccctgcaacagcacaaacggcgccattgattgaagaggatttgcaaagtgatacgattcgaagcgaactgcaagagatagaaagacgaacagctgctgctgccggagacttgatttatcagatgttcgacaaaagtttggcactgacgccctatacgcaattggccaatctaacgggccaacctgcaatcagccttccaacagctgttagtgaggaaggtttgccattgggaattcagtttatggcatcaaaaggccgtgaagatttactttttcaagtgggtgaattgtttgaacgatgggagcaatttcatttacccaaaaaataactgtcgatgaatgacggttcaagaatgattttctagggggataaagatggaaacaatcaaaataaacaagtggaaaaatatcgttgtactaggtgcctttgtgatgttgttaggtgcttgcggaagtaaggctaaagaggacaatagtttaagtcgtgttcaagagtcaaaagaattgactgttgctacgtcaggtacgttatttccttcctcttattacaatgatgacaatcaattagttggctatgacgtagacgttgcaaaagaagtagccaagcggatgggtgtttcgatccagttcaaagaatacaatgtagacggacaagtggcgtccttgactagaggtgaagcggactttgccgcaaatgatttcggtctcagcggagaccgtggagataagtttcgtctgtctgaaccaatcaagtattcatttgatagtatgatcgtgcgaaaaagcgatgattctggcattgcctctctagatgatttagcaggcaaaaaagcagcgggagaacccaatacaagctacatgaagttagccgaagaatatggtgcgaaacttgtgacctatgataatgccacgaatgaccagtatctgacagatgtggcaaacggacggaccgatgtgatccttaatgattattatctgcaaaagatgtcggtggcagctttgccagatattccagttaaaatcttggaagatgtctacttcaatccgaacgaaacaggctttctttttgcgaaagacaaccaagcactgcatgacgaagtcgatcgtgttttaaaagagatgaaagcagacgggacgttaaaagaaatttccgaaaaatacttccaaacagatgtatctgtaccatctgacaaagagatccaaaaggttgaaaagtaatgtatatcccaactcttgatcttccactgatgtgggagtcgcttccttttttactgacagggttatcctatacgttagggattgccattgcttcttttctcgcaggaaatgcgttaggtttattgctgacttttctggggatgcttcaaaacccttgggtaagaaggatcgttcgaggctatatctcctttctgcgaggagtacccgcattggtgctgttgtttttgctctatttcggattgccgtatcaattacccgcattgacagctgccattatttgttttagtttgactagcagtgcttttattggagaaatttatcgaggatcgatcgccggagtggatcgcgggcaatgggatgcagcgtatgctctgggattgagtttttctaaaacattacggttgatcattctgcctcaggcatttcgcatatcggtcccagcattaagcaatgtcgcgatggacctgttgaaaggaacctcgttagcggcaatgatcacgatcccggacatttttcaaaaagccaaaattgttggcggccggacgtttgattatatgtcgatgtacgtgttagtggcgatcatttactggttgctgtgtatcgggatcgaagcgctccaacatcgcttagaaaaacgatttgctgaccgctttgaaagtcaaaaaggctgatcgtcaaaaaagctgatcgtcaaaaaagtagctaaaaaaattcgctggttggattatttatgaatcaatctctttgtttgtggtacactttacaaaaaaggagtttggacaatgaaatatgaatggcgaaaacaagaaaaagcttactatttaccaaaagaaccacagctgatcgaagtgcctgcttatcaattcattacgttgactggcgaaggaaaccctaaccgtcctgaattttccgagcaaatcagtgcactttatatgatggcctatggattgcgcatgggattgaaaaaaggctccttcggcaatacgccttttgagtatacggtatacccgctagaaggcgtatggactttacctgaaaaaccacaaggaccgattgctaaagaagagttgatctataaaatcatgattcggcaaccggaacaagtaactgctgatttagccgccgaacagttgacacaaatcatgaagaaaaaagaaaatcgttttttggaacgaattcgtttcgaagaataccaagaaggctggtccgtgcaagcttgtcacatcggtccttttgacacagaaacagaaacgtttgcgaaaatgcaagactattgcgaagcccacgatctatcaattgttcccacgatgggcaattatcagcatcgggagatctatctgtcagatccgcgaaagacagcaccagaaaaagcaaaaacagtcttacgctggcgggtagccaaaacaaacaaagaatccgcttgatccatttaaccgttggtgtacttaatgaaaacacgtaatgaaaagagagagaaccgcgcttaagcgattctctctcttttactactcatcttttaagtagtcttcactggtgaattcactgtgaaaatacttgccttcgtcgccgtaataggtattgtaccgttgcttgaatttgcggaatccatacaccactaatacttttaagagacagtagatcggtattccgaaaatgacacctacgatccccatcaaatcccccataactaataaaacaacgagaatcgtgatcggatggatctgcagacgatctcccattacacgaggaacgaccaagtcaccatgaagcagctgtacggcgaaccaagcaatcaggaatttgatcagcattcctgttgaatcttgtgctgcgatgaaaagggccgggaagaagacgataaatggaccgatatatggaatgatacataaaattccggcagcgatcgccaagatacttgcatattctaaaccaatcagcaaaaaaatcacccaataaattccgcctaaaataaaggaagaaataatctgtcctttcagaaaggcaccaacttgtaggtcagcgatctttacgatcgtgttgaaatctttacgaaatcgcggtggtacgattgacaggagagaataataaaacttgtttggatttcttagtaagaaaaaagcaatgatcggacctgtaaacaatgcgataaacaacgttgagatcgtcgaaaagatactgctaagccctgcagcaccggtttgccaatagtcaccaatgaaatccatgatattgttggcaactttttgaagagtatccgtgatctgatcgatctgagcaccaaatggcgtattcgctaggaatgagtcagcgtttcgctcgaaatcagcaatcaaatctgggaattgattgatcaaatcggttgtttgtttttggatgattggataaagctgaaacccagccaaaacgatcactaaaagaatcagaagatagatcccgccaatggaaacaatgcggggaatctttttcgtttctaagcgatcaactaacggattgaacaaataatacaagatcaggccgaataaaaatggtggaataagagtagaaataatgacaaaaaaaggatcaaaaagaaacgagatttgtttaagtaaaaaagcagcgatcgcacagagaatgatcaatcccagtacataatagctggtttttcctcctaaaaattggattaaacggttttttttcatagaagagcctcactttcttagcctcattataacgaaagcagcactttctgtaaaaaaagagcgagtcaaaccaattttattttttacttttgcttatttgattcgtttatagatatgtaagggcgccacttacgaagcaatcaaaatacaatagaggaggaaaagaagcgatgaagaccaaaaccaccacaaggctgacgattcgaatccaagcaccagatgcagaaaaaactgtcagtcagaccgtcaatcaagtcatgaatgctccagaggaggctaagatgttagcgtttggtgaagccatggcaggattttctaagaatgcgtctttggctggcgtggtagaaacgatccagaatgagtacgtaaaataacgaaaggagagaaagcgatgaaaaagcttcatgcattatttttgactagcgagggcaaaaaacacacattgcagccaaaagtttttgatgaagagataacggcagaagcagcacgaacagcaatggagaatattacaaaaatcggtatctttgaatcagatggtgtccgttattacaatgagctgtctggcgccaaaatcgtagagacgattgagacgccattgttttgaaataagttgaagtagaacgttcatcaagaaatgctcgacaatcaaaagggactgtgccataagtcagtatccaacaagttaaaccgaataatagtctgttgctagcatagattcctctgacttttgcgacgaggagtccctgcaccgcaggagcaataatcattaatgttcggctagtgttacttgtaggagacttatggcacagtccctttatttggtgacggcagttaatgtacaacgtccgacagccgttttcgtgccatcggattgtctgatcgtagcttgccaagtttggatctttccaccgattcgatcagggacagcttccacagtaacagttccttgtttgaccgcttttaaatgattgacttgtagatcaatcgcggcggcaaattggtcttcagctacggcttgatttgcccccagactacaagctgtttcaatcaagacggcattgataccaccgtgcagaagaccaaaaggttgtttatgctgatcggtgaccactaaagataaccgaacctgagtagcggttgtttcttcgatctggatgcctaaatagtcaagtaagttcatagagttcctcgttttctgagaatttgatgatttgattataacaaacgtttgacagaaagcaatttctaacgaaattcgctcagaaatgtgtataatggaaacatgtgacataaggaggaacctgtaatgagagaatggaaaaccttaaaagaatacgatgaaattttatttgaacatcatggtaaagtggcgaagatcacgatcaatcgtccagaagtccacaatgcctttacaccgaaaacggtgtttgaaatgatcgatgctttttcaatcagtcgcgatgaacctggcattggggtgatcattctaacaggagctggcgacaaagctttttgttctggcggcgaccaaaaagttcgcggacatggcggctatgttggtgaagatcaagttcctcgtctcaatgtgctggacttgcaacgtttgatccggacattaccaaaaccggtgatcgctatggtcaaaggttggtctattggaggcggaaacgtgctgcagctggtttgtgatctaacgatcgcggcagataatgcgaaatttggtcaaacaggaccgaatgtcggcagtttcgatggtggctacggttcaggctatcttgctcgaacgattggccacaagaaagccaaagaagtttggtttatgacgaaacagtatacagcagaagaagctttagcaatgaactggatcaatacagtcgttcctcttgatcaagtggaagatgtgacgatggaatgggcagaaacgatgctgcaaaaaagcccattggctttgcgcatgatcaaagcctcaatgaatgccgatacagatgggctagccggaatccaacaacttgctggcgatgcgaccttattgtattacacaatggatgaagcaaaagaaggccgcgatgcgtttaaagaaaaacgtcagcctaatttcgaccaattccctaaattcccttaatgaatggtagttggctgcaacggcaagcacaacttcatccagaacgaccagctttttattggcaagataaaagctggtcgtttgctgccttgcaaaaagaagtcacggcttatgcttgctattatgaacatcggattcctcaaacaatcgagcgagtagcgattttaagcaataactctcctgagatgtatttcacgattttggcactttgggaattaggaaaacaaattcagttcttaaacactcgattgactgaaaaagagctgtactatcaattaaccgatgctgcctgtcagtgggtagtcaccaatcgatcgctttccttgccgagaatcaagttcctgccttttggcaaattgcaagaacgttttttttctgcgccgatttcgatttaccaaaaaacacaagttgcatcgatcatgtacacttctggcacgacgggtaatcccaaaggagtgcctcaaacatttggcaatcattttgccagtgcacaagccacgcagatcaacttgtcggtgactgctgacgactgctggtgttgtgtcgttccgttgtatcatattagcggtttatcaattttgttgcgttccttgattttagggatcagtgttcgattatatgatcgattcgatgcgcagcaaatcgcatcagacctagctgctggtaaaggaacggtgctctcgttagtgaccaaaatgctgatcgatcttttgcctttgactggagacaatggttacccttcattgcgctatattcttttaggtggtggtccgattgccagatcagtcttgatgcaatgccaagacaagtgcttatcagttattcaatcctatgggatgactgaaacttgttcgcaagtcgttgctttgcctccagataaagccgaggaaaaaattggttctgctggattaccattagcccaagtcaatttgcggattcagtcgcagtctttgaaagaatctgttatcgaaaaagaaggaaaactgggggaaatccagttgcaaggacctgcgatcgttacgtgctatttgaatgatcgcgggttggagcagtggacgcaggatggctggtttgccaccggtgatcttggctatttggattctgaagggtatttgtatgtggtatctcgtttgagcgaattgattatttccggtggcgaaaatatttatccagctgaagttgaacaggcattagttagccaccctgcaattgaagaagcggcagtggtgggcgagccaagtggagtgtggggacaagagccagttgcttatcttacactcaaagagccgattacattaccagaattgatcgcctatctaaccccacagcttgctcggtacaaacacccccgtcgctattatcaagtaaaagaaatgccgcgtaccgctagcgggaaaatagtaaagcgtgtattgctgacagaagaaagagtgaactacattgaacagcaaatcaaagaatgagtatcaacatgcattagctgctggcaaaaaggtgtttagtcattattacccacttgcaccttgtgattttgttcagttatatgctgctgccagtcaatttattggtgaacgttatttttggcgatcatcagatcaagcaacctgttttttgggtatcggcagtgtgaaacggtacgcgaacccatcattgattgattttgagcggcagcgtcgaaaccttaaaaagcagcattttcaaccaaatacggaccaaatggctgctacattattaggggcttttgcttttgatgaacaaagccaaggagcagcagaatggggcacaatcggcaatggtctttttgtgttgccgaaaattctttttagaaaaataaatgatgtgtatggtgtgatcttgaccgtcgaagcgaaggatacgaatgacgtggaaacgctgttcggacagtttgctgatttacaacaactcgttgagcaatggggaaagcaagcacaacagcctgtaggggcttgtttgttgcagcaaacagaattagacgtaccacaatgggtaaaagcggtcgatgagacagtcgctgcgatccgctctgcaaaaacgcctttggagaaggttgttttagctcggcgaatgaaaatcactactaagaaggagattgattcctttgcggtgttggcccgtcttgcagagcaacaaaccaatacctatctctttgcttttgaagacgaggtttcgtttattggtgccacaccggagcgcttgttaaaggcgactgccagtcatttcgagacagtcagcattgcagggtctgcgcctcgaggcagcacaccagcagaagatcagcaaatagctgatgcattattaactgatcccaaaaatacccatgagcatcaagtagttgtcaatcgtctggagcaggcgttgtcttccttattggcggaagggttccattcagaggcgcgatcgatcatcaagaatcgcgacattcagcacttattcgtgcctttgtctggcaagcggaagcccgctgtttcttttttagaagcagtggctaagctgcatccaacaccagccctaggtggggagccaaaagctgatgcgctggcatggattcgtaaccacgaacctgcgcgtcggggattatatggtggaccaatcgggtggctaggtatccaagaagatatcggagaatttgcagtagcgattcgttctggtgtttttcatgggacagaaggcatcctttacgcaggatgcgggatcgtcgccgattctgttgcagaagaagagcgccaagagacagccttgaaattccaacctatgctaagaggagtgatagagaatgaatcagcaagtcatgactgactacttgttggcagcaatccatgggtttaaagccgctggaataaagcgagcggtgatcagtcccggatcgcggtcgacaccgttggcattgcttttgcatcgggatccagaaatcacttgttggatcgatgtcgatgaacgttcagcagctttttttgcgttgggaatgaccaaagtcgatttgcagccgacacttttactatgtacatcaggtactgctgcagccaattactatccagcaatttgtgaggcggaagccacaaattttccattgatcgtcttaactgctgatcggccaccggaactacgtggtgttggtgcaccgcaagccatggatcagcaaagtctgtatgcttctcatgtaaaaaaaatggtagaaatgactgtgccggagaatacacccaacatactgaagtacagcttttggcaggctgccacgacaacgatcgaagcattaaagcagccacgtggtcccgtacacctgaattttcctttgcgggaaccattactgcctgacttcacgcggacttgttcgatccaacaaaatatcgcttacctccctacacagcaatcgctacctgcagctgtattgacagaactggcaccattgtttatgaaaaaagggctcctagtggtaggtgaaagtttgacaccttctgaagcagaaacgctgcatgcgcttgccaatcatcttggctggcctctagtgggggatccactgacaaatttggccacttgcggggaaacgtcggctcattttctcccacaggctgatttgatttttccacaactagatgcggactttattcccgaagtcgttattcgttttggtcgcttgccagtgaccaaaaatgtcttgctttggttaagcggtctgccggaaggcatcgactggcttttcgtggatgaatctggacagtggcaagatcaattgcatcgctcagcctttttgctacagcttacgatagaggattttgtggagcaagtaagcaagttgcctagcagaccacaaccagaatggtttcagccatggcaaaagctgcaagccgtcgctgaggaagcattggcaacgactcattctttaacggagtggaatgaaactgctgctgtacggatcttgcaacaaacattgggacatgatgcccaattgctcttagcaaatagtaatgcgatccgctttgttgatcgatacggaacggttacaggtagtgcttaccaagtatttggcaatcgcggtgtgaatggtatcgatgggttgatatcgaccgttgctgggatcgcagctgccagccaaaaaccgacctatttattgattggcgatctagctttctttcatgatatgaatgggctgcaattgctcaaacaatatcagctgccagtcacgatcattttactgaataataacggtggggggattttttccttcttatcgcaaaataccttgtcagaaagtgactttgtgccgctatttggcaccccgttggatcttgactttcagcaagctgcaaaactttatggcgcgaaatggcacgctccagcaactttgactgattttgcctcccaaatcgagcaatcattaacgacgccttgttttcagatcattgaagtagttggcctgcaaaaagatcctgtgatcgcttggcaagcgttgcaacaggagtttcaggaaaggatctccaatgaaaataaacgttaacggtgtgaactatttgtatcagtggtatcgaccttatctggctgatctgccgaccctcgtagttctgcacggatttactggcacttcagattcttttcgcccagtgtttgctcaagaaacgtccttcaatgtcttagcaatcgatttgttgggtcatggtggttccgccagtcatgtgcacccgttacgctatgagatgattcagatggtaacggatctggcagaattggtggatcgtttaacggttgaccgttattatctttatggctattcaatgggtgctcgtacggcattggcatggacggttgctttcccagacaagatcgctggcttgatcatggagagcggctctccgggactggaatcagaatctgcccgcagtcttcgccgacgcaatgatcaacgtttggcgatacgattgattcagcaaccgctggttgactttgttgattattggcaagaactgccattgtttgctagtcaaaaacgattaccaaaggaaatacagcagcaagtacgagcgacgcgtttgagccaacaggcgtttggtttggcgatgagtttgtactatagcggaacaggaacacaacctagcttctggcaaaatttggcagacattcagtgcccatttctggttctcactggagaatgggatgaaaaatttttcctgatcgctaaaaaaatgcagcagcaacaaccagcgttgactatcctctcggtgtcaaaagccggtcattgcgtgcatttggaatgtccagatgtagtggcaaatgaagtgcatgcttggttgaccgcacactgatattggaaaaggagagcgcgtatgaaaatcgtcaaagcagaacggattgcttgtcgactcccgttgaggcagccttttgagacgagttatggtcgcttgacggaaaaagcatttgacctgcttgtactgaccgaccaagacggaaccgtaggtgttggagaattggtggcttttcagcaaccagattatattgaagaaacgttggcttcagctcgagaagtcattagcaagttcttattcccattgctgacaggaaacatcgatcatccgcgagatgtttggacgttatttcaaacagttcaaggaaattttatggccaaatcagcagttgaaacggcgatttgggatttatatggccgccaaaaacattgcagtctgacctctttttatccaacaacaagagacaagcttgctgtaggggtcagtgtggggattcaagcatccacagaacagctagtcgcacaagtcgctgattatgtagcgcaaggatatcagcgagtaaaaatcaaaatcaagccgggagtcgacttagagccgttgacagccgttcgggaaacctttcccgagctattgctgatggctgatgcgaacggcgcttatgaagatcaaccggaaaagattctcgcattagatgaattggggctggcaatgatcgagcaaccgttgaagatccgggatctagtggggcatcgccgtctgcagaagcagttaaagacgccgctatgtttagatgaagatatacgtactgcagaagatgtcgctgttgttgcctcattagatagttgccgagcaatcaatctaaaaattccgcgagtgggaggaatcaccgaagcgatgcgaattgtttcagcctgccaacattatggattggatgtctggctaggtggaatgttcgaatcaggagtgggacgagcgttgaatctgcagtttgccagccaagctcccttccacttccctggtgatctatctgcttctgatcgttatttttacgatgacatcgtcactgaacctgcgaagatcaaaaatggctgtcttcaggtgcctgttggtgtgggagcgggcttcacactagatgaaaagaaaatagctgactattgtgtttcccgtactcgtttgttaggttgaactttagaaatagtttttgatcagcagatcaattatcaagcagcaaaaagcaccttctcgcttttagagagggtgctttttgctgttatttggataaaagggcgtgcaagcgcctgttgctaagcctgttctttaaattctttctcaatttgcaaacggcgaactttcattgttgctgtacgagggatcttttcaaagtcccagagaattggctgattcaaacgaggaagatcttctactgcttgccaccaagctgtccaatccatttcacggtttggtgctaaggcaatgatcggttgcggtgaattttctttgtcacgaacgatgaccacttcagctagaaaatccaatgtatctaaaagcagatcttctaaagctaaattactatcgatggattcaatcagatccacttggcggtctttcaagaataaatgcccttcttcattcatgctgccataatcgccgctatcccaccaatctccataaacattctcagtaaaacgctgatcttctttataataagtcaatgcccgtcctttggataggaagtggatatgtccgtctgtatttgcaggcaactcattgccgtcagcatctgcgattcgtgctttggtcaaatcgcctaaaccaatccccatatcgcgagcatcatttgattgtatactttctagcgtatgtgctttcaggatcattgggccgcactcgctttggccgtatacttgcaagaagatggcatcttgattggcagaagtttgtaagaaagctgccattgtttgattattgatggcatcgaatgtggagtgataataccgtattccagcaaaagcttcaggatgttcttctgcaacgaatcgccattgcacgaagttatttgggtgtgtctctaaggcaatcggtggattctctttcaacatccgaacgacgtgaggaccattcgcactagcaagaggcatcattggaaagcccatagacatcaaagaagagatcccaatattgaagcgagaatgaaccggtgaaatatggaacgccactaattttgtttctgcgatttttgtgaagacagttcgctgccactttgtccgccaccccatagaattggccgagtgacaaatcaattttggtattcctgttgtgcctgaggtgtgggtcatataagaaatttgatcgtgaggcaattcggtttggccaacaggttcagctggttgcaacaatagattgcggacagcaatctgcttgttcgggctgctgtttttgacagctgccactcggttttctgtctcttcaccaaaaaggatataaggatcttctaagcggtcaacaaagacttcgatcgttgaagctggaaaatgataagaaatcattgctgggacagcgcctaaataagcagcagctgtagctaaaagatacgtatcaaattttgatgatttatagataatgattttatctccggcttggacgccaaggtgggcaagttgatacgcccgctttaagattatttcatgacttgaatgatatgtgctgcggtaacccaattcaggaaaagctggcaagatctcatcatgaatgattgggacgtctggataagcctccgccgcatcgcggtaattggtataaagattcaatggttgatacgctaaaatagacaaaataacacactcctttaaattgatgacggtgttttgttaacttcgatggttaataaagtcacctttctcaaactatggttcattttaacatagcgtttttttaagaatagttactttgggatttttttcacataacgtcttaaatcaactgacttacaagccgggtagggctattttgagacaatcaagtttgattagtgatactcgattggtatgttttgattggcacaagggcaaccgaggatagttagaacaaaagattctattgcgaacatcagcaggacgatagttgtcagtatgtctttttattgctatcatgaaaaaaaagacaaaggaagatcctgatggccaaaaagatacaaaataaaaaacatgtttcgcttcctcgataccagcagatcgctgtggagatcgcggaaagaatcgtggaaaatcgctacgaagttggacaaaaggttcatgcccgttcgacattagccagtaacttcaatgtgtcgccagaaacagcccgtaaagcaatcaatgtcttggtcgatttggggatcatggatgtccgtcatgggagcggcgcgtatattgcctcaaaagaaaaggcgcaatcttttttggatcagtacaaagatgttcaatcgatccaagagattcgtaaagacattttagaaagcgttgaacggcaacaacaagagctggataatttttcggaactattgaatgttttggttcggcaaacgaaaaaagtgcataatatgagcccttttctgccatttgaattgttattgaaagaagatgcccagcacttagagaaaagtgtccacgagctgaatatttggcaagtaacgggagcaaccatcgtggcaatccaaacggaacaagagttattgctctcaccaggcccttacgccaagtttagtgccggcaatacgatttattttgtcggaaatgagttggcactacaacgtatgacgaactttttttatccacaagactccgctaattgaagagcgaaagattccatttctaagaagagatggaatctttttttgacaaagtgaccacatgctgttagtatagtatggtcactttcgtgaaatttttcagaaaaaggagtcagtataagtgagtaaagttaaagttgcacatttaacgaaaatctttggcaagaagaagcaacaagcgtttgccatgattcaagaacaacgcagcaagaatgaaattctagaaaaaactggggccactgttggcgtctatgatgtgaattttgaagtcaatgaaggagaaatctttgtgattatgggactttctggtagtgggaagtcaaccttgatccgtttattgaatcggttgatcgaaccatccggtggagacatttatattgatggggaagacattgcgaagatgagtaaagaagaattacgtgaagtccgacgccataagatcaacatggttttccaaagctttggtttgttccctcaccgaacgattcttgagaatacagaatatggcttagaggtgcgaggggttcccaaagaagagcgagtagccaaagctgaaaaagctttagctaattctgggctattatctttcaaggatcaatatcctgatcaactgtctggtgggatgcaacaacgggttggtctggcgcgagcattagcaaatgatccagagatcttattgatggacgaagcattctctgcgttagatccgttgattcgtcgtgaaatgcaagatgagttgttagaattacaagccaatgtccaaaagacaattatttttatcactcatgatttgaatgaagccttgcgaattggtgatcgcatcgctttgatgaaagatgggcaaatcatgcaaattgggacaggagaagagattctgaccaatcctgcgaaccaatatgtgagagatttcgtcgaagatgtcgatcgctcgaaagttttgacggctcaaaacatcatggtaccagcactaacgacaaatatcgaaatcgatgggccaagcgttgcgctaaatcgaatgcgtaaagaggaagttagtatgttgctggcggtagacaaaaaacgtcatctaaaaggtagtttgacagccgagtcggctcgcgaagcacgcaaaaacaatttgaccctaaaagaagtcatcgataaaaatgtacaaaaaatcgacaaagatatgctagtgacggatattttcaatttaatttatgattccccgacaccgttagcggtggttgaaaatgatcgtctgatcggtgtagttattcgaggcagtgtgatcgaagcactggcagaaacggattcatcagtgacagaggaaggagtggtcgtcaatgggtaattttcttcaacaaacgattccagttgctgattgggtagagtcctttacagattggctaacaggaacttttagtgggctcttttccgcattgcagtcttttggtcagttcgtgatggatggaatgactaatactttgctttttgtgccaccactagtcatgatcttgctgctgacaatcgctgcattttttgtttcaagtaaaaaatgggggttgacggcatttacatttgtcgggctactgtttatctacaatcaaggtttgtggactgatttgatgaatactgtcacattggttctgctctctagtctggtatcgatcattatcggtattcccctcggaatcttaatggcaaaaagcgaaaaggcgcaaagcatcgttacgccaatcttagatttcatgcaaacgatgcctggcttcgtctatctgatcccagcagtcgctttctttgggatcggcatggtaccaggggtttttgcctcagtgatttttgcattgccgccgactgtacggatgactaatttaggaatccgtcaaatttctcgtgaattagtcgaagcttcggattcctttgggggaactggctggcagaaattggtcaagttagaattgccattagcgaaaagtacgattttagcaggtgtcaatcaaaccacgatgcttgctctttcaatggtagtgattgcttcgatgatcggtgcccctggtcttggacgaggtgtcctatctgcactgcagcgggcacaagtcggaaatggatttgtgagtggggtttcattagtgatcttagcgatcattatggatcggtttacccaaaacttgaataaacccgctcataagaaaaaagccgtgtccgcgaaaagccgcaagcaaaaacgtctctttggcgggatcgctgccgcagctgttgttgcgctgattggtgcttctgtagcttttggtcgtgtttcagacaataaaggaacagtcaacttagcatatgtcgaatgggatacagaagtggcttccactcatgtggtagctgaagtgttaaaagaaatgggctatgaagtcaagacgacaccattagacaatgcgatcatgtgggaatctgtggctaaaggcgaagttgacgggatggtagctgcctggttgccttcgactcaccaagctcaatatgaacaatataaagaccaagtagaaaatctaggaccaaacttagagggagctaaactgggaattgcagttcctagctacatggcagttgactctatcgcagatctatcggatgaggcaggaaaaacgatcacgggaattgaaccaggtgcaggtgtggtcgctgctgctgaaaatacagttgcaacatatgataatctttctgattggaatgtggcgacatcttcttccggggcaatgactgtggcgttaggacaagccatcaagaataaagaagacattgtgatcactggctggtcgcctcactggatgtttgcaaaatatgatttgaaatatctagatgatcctgaaggaacgatgggagaagcagagagtatcaatacgatggtacgccaaggattagctgatgatctgccagaagtttatgaagtactggataaattcaattggacacaagaagatatggaagaagtcatgctgtcaatcaacgatggaacttctgctgaagatgctgcaaaagattgggtaaccaatcacccagaagaagtggcagcttggacgaagtaagtcaatgaagcatgaaaggatcagataaataaacaaaaaaagaaagtttcgcatctagactcggtggccgagttcaggtgtgagactttcgtttttttcactatctactgactgtctactgatagtagccagcaattttttgtgctttttcagtattggcgaaatgcagtttggtatacttcgctaataaaggcattccgcctttttgcaaaagctgagcagcgacctgatcggatttgctgccggcacccgaaggaagctgtaatccaacttcttgtgaggccttctctagttcctccagaaaaacagtgcggcatagaatggaggccgcagccactgctaaatgatattgctccccttttgttgcaaaaaacaatttttctgtgatttgatttttttctgattttagataggtacggtaatttttttcgctagtgaattgatcaatcaagatagcatccggtgtttttggtgcgattttttgcaacagtagccgaatggcttgattgtgtagcgcaactttcattcgaacggtgttgtatttaggttggatctcattgtatttagttggttcaactgtcagtaattgataaggcacaagtttttttatttttggggccattgcccgaatttgtggatcagtcaacattttggagtctttgacacctaatgctttcaatgcgggtagctgatctttactggcatagacagcgcaaacgactaaaggaccaaaataactgccattgccaacttcatcactaccaacgacactccactgtgaaaagtcagcaggcaaggaggatgaaggagccttgttgttcgcatttgctgttttggacaagtcggcagaattgctccaacgagctgcttcagcttctgcaccactaccttgaaacatcactttaccagaagtataagcggtgatggtcgtttgttcttttttggcaacaaacacggtataaggaacttttttattcaacagcgcttgctgatagaagttcatcatttctgcgatagttttttgagatactttaatgacgatattactcattgtcttcctccgatatacatactggttatttgaatagaacatcttcttagattctaccataggtaaaaattttacgaagcctctttctaaaaaaacgattggcatggaaattacactagaaatcacgtataataggtaggagtttgcgatacgcgtgcagaaagtgataaaatagtacagaacagcaatgggaggaatctttcctatgacggagcaaaagaaacgttataaagcagtaatcgccaatcaaagctacacgattattgggcgtgaaagtaaacaacatatggatatggtaacgaaattagtcaatgaccaattgacagaaatcatggggctgtcttctcaagtcgataaagagcaagcagcaattctattagcaatcaatgcgatttctgatcagttgaaaaaacaagagcaagtattaagtttgcaaaataaggtagaagagttacgcagtcaagcgattaaggcgaccgaactagaaaatcggattaagcgaatcgaagcgattgagtctgaagcgcgccaagtattggatgagacaggtcgcggagatgtggagatccataatcatgtggaagctcaacaaatattaaatgaacaacgtaagcgcaaaatccaagaaaaagcagctcatggttaagtaggcgcggaaaggactctgaaatgataggatttttggttctggttcttttgttagcggcattttatggtggcgcgcggcgagggacttcattgcagctggtctccgttttaggataccttttttcttttttagttgcagtggcaaattaccaagctttggcaaaaaaaattgaattatatgttccttatatgtctgtgaccgcagactcaaagttggtcttttataacctagatcttgctctagacctagacaaagcgtactatgcagctgtcgcttttattatgatcctttttgctggctggttagtgacaaaattgatttgcatttttgcaaatggactgcgtttcaaacgtctgcgttttttcaaaggctatgattgggtcgtagcagggatcttgaatacgctattagtttacctgaatatctatttcttttttatgatcctctcgatgattcctttagcgactatccaaaatttgtttgataagagcagcacggcacactttatcgttgaaagttcgccaatcatttctgattacttttatcgtttgtggatcactaatgtgattggttagtataaggcagctggtcattagacccatgctgctttttttcttaagtaaaaaaatgaaaaagtaggtgagactatgaataaaaaaattcttgatgttttagctttcgatcaagtaaaacaattggttgggcagtatctagtgaccgcccaagggaaagaagaattagctcaattagcgccatcagcagatgctcagcaaatttccacttggctggctgaaacagaagatgcgttaaaagtacagcgattgcggggcggtattcctgtaccaaaaattgaaaatattcgtccgcaaatgaagcgaatcgaaatcggagcggaccttaatggtttagaattagcgcaagtaggtcgagtgttggtgacagccaatgaattgaagcgtttctttgaagatctatcagacagcgaaatcgagttcgagcgactgtatgaatgggaaaagcagttagtaacgctgcccacgcttagccgtcgcctgaaagaagcagtggatgaagacggtcggttgactgacgaagcatctccagagctacgtgtcattcgacaaaatattcgtcgttctgaacgaacgatcagagaaacgttagatagtctcgtacgtggcggaaatgccaagtatttgagcgataccattgtcacgatgcgaaatgagcgttatgtgattccggtgaagcaagaatatcgtggcgtgtttggcggggtcgtgcatgatcagagttcttctgggcagacattatttattgaaccaaaacaagtggtggatcagaataatcgactgcgccaacatcaaatcgctgagcgtacggagattgaacgaatcttagcggaactttctgcagagctagctccttatcaacgcgaaattctgcacaacgcctatgtgatcgggatgatggacttcatgaatgccaaagcacgttttgggaaagaattgcaggcaatcgtgccggctatcaatacagataatcatgtcgttttcaaacaagcacgtcatccgctgatcgatcaagaaaaagtcgtaccgaatgatattgctattggtgaagactatcaagcggtggtaattaccggtccgaatactggtgggaaaacaatcaccttgaagacgctgggattgcttcaaatcatggggcaatctggattgccgattttagtcgatgaagagagccaaatgggcatttttcaagaaatttttgctgatattggggatgagcaatccatcgaacaaagtttatctaccttctcttctcacatgacgacgatcgtcgatgttctcaaaaaagtggaccatacaagtttagttttattcgatgaactgggagctgggactgatccgcaagaaggcgcggcgttagcgattgctattcttgatgaacttggtgcacgctctgcctatgtgatggcgacgactcattatccggaattgaaagtgtacggttacaatcgtgccaataccatcaatgcttcaatggagtttgatgtcgataccctaagcccaacatatcgtttgctgatcggtgtgcctggtcgcagtaatgcttttgaaatctccaaacgtctgggcttggacacccagatcattgagcaagccaagcaaatcatggatggcgaaagtcaggacttgaatgagatgatcgccgacttagaaaactggcgcaagatgaccgaaacagagtatttggaaatgcggcattatgtagaagaagcggaacggctgcaaaaagaattgaaacaagcatataactttttctttgaagaacgcgaagcagaactagcaaaagcccgcaagaaagcaaatcaaatcgttgaaaaagcaaaagaggaatcggaaaaaatcatttcggatatccgcaacatgcaattgagcagcggacagagccatgtcaaagaacatgagttgatcgcagcccgcacaaaattgtctgatcttcatcaagaagaacatttgcaaaagaacaaggtcttgcaaaaagccaaagctgcgaaaacattgaaggtcggcgatgaagtgttagttacttcctatggtcagcgaggaactttgatcaaaaagatgggacaatcacaatggcaagtgcaattgggaatcttaaaaatgacgctgcctgaatcagatctacagccggcagcacctgtcaaagaacctgtgcagcgcgtcgttcataccgtccgttcagcggagtcttcacatgttcctaatcagctggatcttcgtggcaaacgctatgaagaggcattgaatgaagttgatcagtatctcgatgcggcgattcttgctggttacccacaagtgacgatcgttcacggaaaagggacgggggcattacggcaaggaattacggaatatttgaaaaatcatcgtagtgtcaaaagttttgagtttgcaccggcaaatcaaggtggcaatggggcgaccatcgtaaaatttaaataatcgttaaggcttcttaccttttgtaagcagaggattttaaaaaagcacgtgaacatgctatactttttttagcaatcaaatggaggcgaacaatatggcaaaagaaattacagataaaactttttcagaagaaaccgataaaggcttagtacttattgatttttgggcaacatggtgtggtccatgtcggatgcaagcaccaatcttggaacaattagcaaatgaatatgaagaagacgaattaaaaatcgtcaaaatggatgtggatgaaaatcctgaaacgccagcttcatttggtatcatgtcgatccctacgctattgttgaaaaaagatggtcaagtggtagataaagccgttggtgttcataccaaagatcaattgaaagaaatggtagcaagccacatgtaagaaaattttatagtaagcagcgatcttaagcgatcgctgctttttttttgagtagttttaagcgaggatttattcttgcaatggtataatgaaagtgtgaatatggggagcgtctactttctatggagtgcttttatttgaaaagggggatgaaaaatgaaaaagaatagaggatgggggtaccggctgctctgtatcatttccttggtcagtgcaccgcttgtatctgcaggtgcgacctacgcggaaacaattgatacaggaacttcttcagtcaatcaagtcaccgaatcaaccaccaataccagtaggacgacaaccgaaacgactgactcaacaactgcgacatcgtctacaatagacacgtcaacttccgaagcgagtaccaacagttcgactgatagctttggggaaacaactacaagtagttcagaaataactgtttcttccacagaagaaacggatacttcagaagcgaatccagtcatcactgttaaggaattagccaattcaaatcgctatgtcaaaatcaacactttcacagcgactacaacggagtcgcaagcaatggatagtcgtcaggttttatataccctcaatcaattgcaactaacagccacaggatcaattactgaacttgcgggtcacgtttataaaagtgtcaaacagtaccaagatacagcgacgaaaaagaagtatagtgaactacttgatgaacagaatcacgtgattggtattgttgaagcagagtctgtcacgacagcagatggggtgtttcagtcagaaaaaaaatatgctactgttcaaagtggcaattatcctttatgggagtcaattttttttgataaacagttagtcacgacaaaaacaatcaatcaacaaacgtttcaagtaaaagaaagtttcaaacacggaaacggctcgacctattatgctctgtacacggataagaaccaatttattggttggattaatgccaaaggagccgcggatgccaaatcacctggaggcatatggcaatctgaatcaaaatacgccacgatcatcagtggcaactacacattatggcaaaattttgattggtcagccaaaaaaggaacgacagctgctttgaatggaaagaccgtcaaagccacaggaaaatatagccatgttaatggtgcaacgtattattcgttgtatgacaataagaacaagtggttaggttatatcaacgctgccggtgtcaaaacgacatcaaatgcacagggagcttaccaggcttacggtaaatatgttactctaacaaagaaaaattatacaatttggggtaattttaactggtcgagcaaaaagaacactacctcttcattgtatggaaaaacttaccaggctaaaggaaaatatgaacattggaacggatcaacttactactcattgtctgattctactggcaaatggattggctatttgaatgctgaagccgctactgtggctaataatcaaggtggcatatggcagagtgaaaacaagacgatccggatgaaaagtaagaactatacattgtggcaagatttgaatttttctaagaagaaagcttcaagtggcaattatatgaacaaaaatatcaaagtcaccggaaaatatcagcattataacggtgcgacctattactcattgtatttaaacaatacatggatcggctatatcaatgctacaagtgtcacaaatgctcatgtaatccattcgcagagcaatattagccgttatgtgatcgtcaacaatgccagcgggaattttctgaatgctgctgatcctaacagcagcaaattaggaaaaaagagtaattataaagggtatatggcgaaagcaaccaaattagccaaaacgagtgatggcaattatctgtatctggtttcaccagcagggaaaatcgggtggctcaaagagaatcagacgtatagcgtgaatgataaattctggatgtacactactggtggcaagtacccctcgctaaatgtcaaaaatttaaacattcatgtgtccatcagtaagcagcgagtttacattaagtcaggcgacaaagtcatttataccatgctttgttccacggggacagtttttacgccgacaccgttaggtaattttagaattcagcaggagaaaggctccgccttttcaggagcggcttattaccgttctttcaaagatcatggtgtctatctattccataccgttccaacaagcattgcttggtcaaccaattcatttagttcggtggaaggcaaaaaaataggacagcgagcttctcatggctgtattcgattagcagtccctgatgctaaatggttctattacaacatgccttacaacactcccgtaaaaatcgttaactgattctagctgctgcatcctttgaataaggatgcagcagtttttttgtagcgaaaagagttgttgatttgcacttcactaattagagttgaaagtttttatcttctgaatagagatcaaggcctttttgatattttactttttgatattttgatagaagttagatttgtaaagtgggtcaattgactaaaaactgccctttgaaagctgtgtcgcccatttgggaaaaggatttctcttttgaatgactgacatgtccgttcgaagcttgatagggagcatcaatctcgaatccctagttgctaactaaggtaagtataaagcggtcaactaagtgtaaatagttctgaaatacgccgatagataatcagaaaactacccaaatccgggagaaaattgcttacaaaaagagattgacacttattatatcattcgataatatatcagtaagtgatatagtttcctaggatgggggaaaacacatggatgaaccattgaccgattcaacttatttgattttgttagctttattaaagccaaaacatggctatgtgatcatgaagcaaatcaatgaattaagccaaggtacctatgaaatcggtccggcaacaatgtatactatattgaaaaaattgaccaaaaatgaaatgatcagtttagaagagacgacagatcgtaaaaaaatctatcagatcacagccaaaggaaaaacggctttagaaaaggacattcagcgacgaaaacatttctttgagattggtgaacagattatgggtgagttggggggactggcagatgagcaaacgtaagacaaaacatttgtattcattaggtgttgcctattatccagaaaaagaaatgatgcggctgcaagagcaagcagcaaaaggttggcagtttgtgcatatgaatcagttcggttttttgaagtttattcaaagccaaccacaagagaagaagtttgctgtcgatttttttcaaggagacaaatctgatgttgatgaatacttggcaatgtatgaagccggcggatgggagtatattagttcctacaaaaaccgttactactattttcaggctcctttagagacaccagctatttttagtgatcagcaaagctatcaagaacgaatcgatagtgaggcacgctatcttatgaaacgttcttttggcataacaggtgttggcttggttattctgcttttgatttatctcctcgctcgctggctagtacttacctataatgagatactaggtttctcatatggtgttgcagttgggctgatttgtgcgcctcttgtcatcggtgtggtgtcatttctcatgcgtcgcttgtacaagaaccgcgcctctttttacaaagaaccagagaaactagctaagcggcaacacgtgttacgggatacgctgctctttatgggagtcggcgcattaattggaagaattatcggctttttagccggttatttatactaacttaaaagacaaggaaggtgaaattgtgttagaagcaaagaatttagtgaaaacatttggggactatcgggcagtggatcaattgtcctttcaaatcaacgatggcgagatcatggggctgatcggtcaaaatggtgctggtaaaaccacgacattccgattgattctagatttcttacgggctgaacaaggagaagtactatggaatggccatcaaatcacagaaaaggaatacaatttgattggttatttgccagaagaacggggactttaccctaaagtaaccatccaagatcaactgatttattttgcacgcttgcgtggaaaaaagaaagaagaaattgaacctaagatcgacgaatggatggaaaaattccaagtaaaagggaaaaagacagataaagttaaatcattatcgaagggaaatcagcaaaaagtccaattgatcgcaacattgattcatgaacctaaattagtcattttggatgaaccatttagcggattggaccctgtcaatgctgagttgctgaaagatggcattattgaactaaaagaaaaagggtcttgtgtcattttttctagtcataacatggataatgttgagaaaatctgcgatcatttgatcatgctaagagatggtcaaacggttctcaacggaaaagttcatgagatccgtgaatcgtttgggcggacgaaagtcttcttggaatcttcattgtcaaaagaaaccatcctagcagttgaaggtgtcgaaaaagttcttcataaagaagatgggagttatgacattacattatcgcatcctgaagtcggtcgcacattgtttgatttggccacagctgatggctatatcccgatgtttaaccaacaaccgccgacattagaagaaatctttaagagaaaggcgggaaaagacaatgagtaaattttgggtgatcgcgctcgatgtgtttaagaaaaacgtgaaatcgatctcgtttttgatcatgatattgattccatttattgcattgggcattatttatgtggtaggaatttttaccgatggaatgaacagtgccgataaaattgctgtttatgcgaatgaaccagctattgcacaaacaatcgcagctcagaaaaatgaagactatcaatttgaagtggtggattctgaagaagctggaaaaaaacaattagcggatgaaaaggtcgatgcattcttgatcgttacttcagaggccgacagtatcaaaggtgaattattgagtgaatcttctatgggacaaaccacagagttgacggttcagcaattattgtctgggttgcaagcctcgggacgtgccgcagcactcggattaaatcaggagcaagtggctagtttaagtgagccagcaaacttcagtaaacaaaaagtttctttcaccgaagatggcaaaatggagcttggggaagacaatagttcgatccaatacattgtgagttacgtcggaacaattattttattcatgtttattttgacttacgctcaaatcattgcccaagagattgcttccgaaaaagggacccggatcatggaagttattttgtccagtacgagagcacaggttcacttttatgccaaattaaccggtgtaattatggtcgcattagctcagttattggcttacgccggtatctttgctatcagttattattggatcaaagacatttcaatggtcaaagatgtattagccaatttctcaattgatggattattcggtccattcttgatttactcggtcatctttgtcctattaggaattttgatttactctgtcctgtctgctttgtgcggttcattagtcaataaagcagaggacactgccaaggcgatcattcctgtcacttacctttctttagccggttatatgttaggtttgattctaggcggtacagatcctaacaatatcattttgcgggtcacttcttatatcccgtttttatcttcatttatcatgccagtccgattggctaacgatacagtaggtatcggaggcgcggcagtctctgtagccatcttagcagtaagtacattggcattgatgctgatctcagcaagaatgtataagtcaaacgtactgatttataacgataacggcattttggcttcattgaaacaatctttcgttttgatgaagaatgaaaaatgaccagccaacaaattctccgattagttaggcttcaataaagaaaccgatgaaaagcttgtgctttctgattaccaaatggtatccagaaaaccctctgcttttcatcggtttttttctacgtagaattaggtaaagtagctttaatgagtcaagaccgccaattgatcaagctagtatccaatcagcctttaattactaactattaaagctaaacgagtcatttaaactactagtttcaaatataaccaagtcttttttcaatcaggcattgcctctgctagcgaaatctttgttggcataatgtcaaaactgatgaacaaagtagtcgaaaatttgctgttctgaagcaatttcttgtgcggttaattcaggatgccattggatccctaaaatcggcgccgcaaaggcagaagtttcaatggcttctacgataccgtcaggggcagttgcgatcacttggaaatcttttgcaacatctttaatggcttgatggtgaaatgaattcacttgataggtggttcctaataattttcctaaacgactgtcagcaacgatctcaacggcatgagtaggaaagcgaaagggtgtcggtgcttgcacatgcttgatggttggttgctcgaccaatgacaagtcttgatagaggttgccgccgaaagcaacattcaatagctgcatgccacgacagacaccaaaaattggtttttcttgtgcgacagcttctttgatcaacgccaattcaaatgcgtctcgttcaggatgtgtaccttggatcagtggatgcatctcttcgccataatagcgaggagtcacatcatgaccccctgccaaaagtaatttatcaatctgggcaacatattgggcggcattttcgggagctcccatgggtaaaataaggggaaggccagaggcttgttgaatctgtgtcacaaaatttctcggggtatatgtaatccaatgggcttccccatcaatcatcgttcgttcgttgccagcaattccaatcactggtttcataagcattctccttccagctgttttgacagcagtaatgaataaaaaactgtgacaaaaggaaaacaaaggaagctatccgaactgactttttccacgaaattgcgaggacctactagagagtagatgcaatttcgttatcgttcggatgctccatttgttgctgcacttaagtcacagtacttttttatttttcgcgaatcacttctattttgtagccatctgggtctttcacgaaatagtaagaaggagaagtaccaggcaagccttttaagtcagtaacatcaaaaccagctgctttatgctgctcgtgaagtttctctaaatcatcggtactgatcgcgatatgaccatagccgtcacctagatcatagccgggatgatcatagttataagttaattctaattcataatcatctcctggtaatgtcaggtaaaccaacgtaaatttgttttctggaaaatcacgacggcgcgattcttcaaaaccgaatgcttcttgataaaatgcaagtgatgcttcaagatctttcactcgcacacaagtatgtgccattttcatttgtcattcatcctttcaattgtggtaagcctataataacataacccgattttttgtggtaagaaaagtgcaccccgtcaagttgcagcttgtcgccagtggcttcctaaggtagaatggaaagaaagagatgatggagggaaacatggggaacaaggagaaagtgtttgggcaaaaagagccgggggctgactatatttcacgattcggtgcctatgtcgtgattccgaatgaacaccaacaagtgattttggtccaagcgccaaatggcgccttttttttaccaggaggggagattgaacccggtgaatcgaaggaagaaacgatcaaacgggaattggtcgaagaagtaggatttgcaggaaagatcgccagttatttaggggaggcggttgattatttttactcgcgacatcgagaaacgtattaccatcatccggcctatttttatttgatgactgattggcaaaaaataggtgagccaacagaacaacacaaccaactttcgtggcatacaccagaagaagccattcatttattgaaacgcggcagtcatgcctgggcagtgaaacaatgggtaaatcaaaaagacaacgatcatgcataaaggcagtgatcgttgtcttttttactcttttattttagttcatttaacacatagtcattgataactttagctacaccatcttcttcattggaagcagtgatgacgtcggccgcttgtttgacattttctgttgcattagccattgcaacgccaagacccgcatattcgaccatcgttagatcattttcgttatcaccaatcgccatgacttctgcttgtgagatacctagttcctcagctagcttctgaaccgcagcccctttatgagctttcttattcaagacttctaagaaaaatggcgcacttttgacgatattgaaacgctcagtcaatgaagttggcaattgtggaataatagcatcgatcaattcaggctcatcgatcatcatcattttgatgatattcagatccgcagtcatttcttccggtgtacgatatttcaaaggcatattgaccaaaaaggcttcatagacggtataaggactgatgtctcgattcgctgtgtacatcgtatcttgggtttccacatgcaaatgaacccctaatttacgggcagtcatttctacttctaagtattcttcatgcgtcaatccgaattcagaaacgatttcttttgttttagtcttctgtacgagagaaccattatatgtgattacgtagtccgtttctgaaaacaagtctagttcacttaataaatcttggacacctgttaaggggcggccagtacataagacgattcgaacaccctgtgcctccgcagcttttagtgcttggtacactccaggtgtgatttttcgatcattgttcagtaacgtgccatcgatatcgatagcaatcagtttgatgctcataacttcctcctagttgttcgtattgatcaaggcaccattgcgaatatgtttcgcaaactcttgatacgtatcccaaaataaatcatagtgattttgtagtgcggggtcaatcatttcttttgggaaataaaagcgctggtctccttgtgtttgaccagcaagtgcagctactagttgactagccttggataattccactagggagccgtctttttcttgcagttcgatttgtgtccgatgcatgccggaagttgggcgataaaagtcataaggtaaatcgaaactagaattgattgctgtgtaatagtcggggttaaaaccgactttttcgacaagagattgcagttcatgaatcaatggcaattgagtgtcttcttcaaaacgtgcagacttcagcggtttgcggttcaagaatcgtttggctaaatcactaagaatcggatcattttcttccgtccactgagtgaagtaagtattcaagacgccatcgtctagttttaggtattcttccaaagtaaagtgctgtttaagaaagggcagcaaaagctgggaatgcgattggaaaatttcttcatgttcttgatacaattcggcagcgcgatttagtaaatgtgccaagataacttccattccccgagaactggcatggaaatagacttggacatacatttgatagcggctgacaatataatcttctaccgcatgcatgccactcatagaaaatgcgatcccgccagcatagggacgaatgactcgcagaatacgtgtcaaatcaaatgtgccgtattccgttcccgtgaagtatgcatcccgcagtaaataatccatgcgatccgcatcgatctgactggaaatcatttgcaccacttgtgggtttgggtatgtcttagtaataacactggccactttttcaggaaaaccttcttccacacgattgaggatttgatagacttctgtttctggagaagtaatgatcgctacagtgatggcttcgtgatcggtatgaaaaatatgttcaaaagtgtgagaataagggccatggccaacatcatgcaacaaagcagcacaaagcgtgaccaatcgttcccggtcatcccagccatcagacccaactttttcaactgggaaatttcgttgaaacaaatcacagatgcggcggctaatttcgtaaacccctaacgaatgtgagaagcgactatgttcagcaccatgaaaagtaaacgaagaagttcctagttgtttgattcttcgcaggcgctgtacttctttcgaattgatcaagtccaagatcacttgatgctgcacatgcacatagttgtgtacaggatcacggaatactttttcaatagcaagtgtttgatacttatatgggatgctcattgtgaactctcctttatcggttgatttcgttgatacatattggtcatacgagcctctagtaatgccgcttgatcatttttttcaacccattcggatgcagtcacagggctgagagaggacttagttagccgcatcaaggcctcttgcagtcgtgaggcagcttctgatacagagaaagaacgctgaagcacatcttggagtgttgtcatactggtaggttcaacggcgggatagccattagtaccaaactgctctttcaagcttctttgataaaacgttcttactacttctcctcgatagtgttggtcgccgttgacactaaggtacatcatgactgcaattcctgctttgatcctgcgctgggcagtccctgcgattttctttccgtccatactcaagtcaaaggtaccgggacaataagagtttgggatttcataggccgcaatttctttttcgggaaatgcttctcgcatcaagtcgaccattcgctgataagccgcatctgtagtagcagctaacgtttttgggaaaatccacgatacattcagaacaccggcatcgttgatgaccccaagcccgcctgagttgcggatgattggttgaaagccagcagtcgtcaaagcggatattccttcggtgaaataaggcactcgggtatctttcattcctaaaatcatagtatcaggcaactgccaaaagtgtaaaaattcctgatgatgaacgcctgcatattcactcaatacatcggtcaatgcaaacggtaaaaaacgattctcggtagtttggggatcaaatggcaacatttgatcaatcatttcaatggtcacggtaggcttagattctccttcaataataagatctcctactattatatatgaagatcatgaaaaaacttaatcaaaaagctaagaaaacgttctatagtggatgttttagctgaaatgattgacaaaagaggggaaaaaaggaaaaatgaaactgaaatctgctaaggaggcacactatcatgagggaattgtcacaaggaattccgatttcgatccatttaacgacaaaggtcgaacaagcgggagaaacacaagattttttgtttgatttacaaggacaggcggtcaaaatcggcgatacgctgtatctgagatacaaagagattcagccagaaggagccgaagtaccagtgacgatgaaaattatgccagatggcgtgatccaactgattcgctcgggagaaatgcgaacacgcttgaaattcgcttacaaagaacgtttagaaacaagttatcaaacgccttacggcacgatgcatttccatacatatacaagtcacttacatgtgagtctgaaagatcgtccttattcaggtaaagtcgatgtccattatgatttatttatgatggaagacaaagtgggagaatacaaactttctttggagtttactgcttaaataaatgcaaattttgaaagaataaattgcaatttgtctcacatttttgtatgattaggagtagactgtgaaaggacgtgtcccgtttggaaattaatgtatttgaaggtgtaaataaaaacgaattgtcaatgatcgaagttgcccatgcgattttagagcaacgcggtgacgtgatggatttttctgatttggtcaaccaaatccaaaactatctagaaacttcggacagcgagattcgtgattctttggcgcagttttatacagacttgaatatcgatggcagttttatttctttgggagacaatcgctggggattgcgttcatggtatgcgatcgactcaatcgatgaagaagtcaaccacggaatcgatgatgaagatgaagatacaccgcgtcgtcgcaaacgtaagaaagtgaatgcctttattagtgacgatgaagacgcgatcgattataacgatgatgacccagaggatactgatttgtctgatgacgatgaagaggatctttttgacgatgatgacgatgaggatgaagaaatctccgcatataactcagatctgcaagaaattggtgcagacaataacgatgatgacgaagaggaactaccagggaacattgaagaagatctaacgatcatcgatgatgatgaagaagacgaatttgatgacgaggaagaagaggaataggcctcttcttttttgtgtttagcaaaggcaacagcgtatggaagatggcaagagctcaatcaaaataaaaaaccacggaagtgctgtcagcacttccgtggttttttgaattatcccttgagataaagtatactataaatgaaatgaaaaacgcgccttgagggaatcgaacccccgtctcaagaaccggaatcttacgtgatatccactacactaaaggcgcgaagcacaaataacagtttaaccaattttctcagaaaaaacaagaggtaaaatgatgaaatttcaacaacaattttcgcaacaacaaaaacagacacaaaagttggcgatgacgcagaaattacagcagtcgatccaagtgctgcaattttcatcagatgaactgcttgctttcgtagataatcaggcattagagaatcccctgatcgatttaacggaccatgaatatccgacgagttatactcaaggcagtgggacatctgagcaattcaatgaatatttgaatcagatcccaaatagaggaagttcgctctttgagtatttgatcgatcaaatccatttaaattaccgagacacctttctacgcaccgtcgtgttatttctagtggaatatattgatttgaatggatttttgaccattgatttggtgaaggctggtcaaatgatcggagcttcagagattcagatgctcgatgccttgacactgattcagcagttggatccagcgggtgtcggcgcacgagatctacgagaatgcctcatgcttcagactgaacgggacgatgctgcgccagaactcgcctatatcgttcttgaagaatggttcacggaattagcagagcgcaagtgggacaaaatagcgaaaaatctagcagtttcgctttcagaaattcagaaggtgtttgactatatccaaacgttgactccaacaccaggggcggcctttgggtctacagatggtttgtatatcatcccagatttgcgagttacgattactgaaggccagccagcggttacctctaatcgacgagcaatgccggaagtccgtttccaacaacactattttgatcaattaaaacaaagtggcgatgctgaggtaaagaaatatttagacaacaaagcccaagaatttgaatggctaaaaaagactctccagcagcgaggagataccatctatcgagtgggagaagcgatcgttcatcatcagcaagacttttttttacaagctgaccgaccattgaagccattaatcctcaaagaaatcgctgacgaattaggtattcacgaatcgacagtcagtcgtgccgtcaatgggaaatatttggagacagaatttggtgtttttgaactgaagtccttctttggtcaaaaagtgtccacccaaagtggagaggatgtcaccacggaggcaatcaagcgacgtttggcagctttgatcaacgaagagaataagcagaagccgctttctgatcaaaaattggctgatttgttaaaagcggaagaagtggaaatttctcgacggactgttgccaagtatcgtgaggctcttaatattcctggatcttctaaacgaaagcggtttgattgatttttcgatacagttcttgttctgatccagctattgaagaaagattcaacaagaatgacggcaaaaagtccaatgaccccacctcttatacataagaagacaggtaagcaatttgggtttcatataaccgtagcaaaggcagggctacttgtgataaatagctctgcccgcttttcataggcggtcgctgatccttttgctcgagtttttctttgttgatttcttttactagtttgaaagctatttttggctgtgataagaatccgctttacggttaaaaaagtttggagaatcattttttataattgaaatagttgcatgaggcgtccagaagtgctactattattggtgtaagagatgaattaaattttttttggaatagatgggtcattttaagtcattgtaggacaaaaaaagtccaacgggaggatgcaaaatgctcgatgaattgaaattgattgaggcaatcaccccggatatcctcgcggtgcttcaagaacgttaccgtattttacggactatctattggatgcaaccagtagggcggcggacattgtctgaaagcttagcaatgacggaacgtgtgttgaggtctgaaacggatatcctcaaaaaacttaaattgattgattcgtctaaaagcggtatgcaattaacggcctatggcgaagaaatctatacaaaaatcggcagtttgatggatcaattgtttggcatgcatcaaacagagaagcggttatccgagtacttcgggattgatcgttgcttgattgccagcggtgatggggaccgtcaaccgaaagtgattgctgaattcggtcagctgcttaatgagtcgttagacttattgctgccagatggtgagaatacgatcgctgtgatgggcggtacgacaatggcaaaagttgccgaagaactaggcaatcttgaaactggcaaacgccataacttgtttgtcccagccagagggggcatcggagaagcagtcaatgttcaggcaaattcagtcggatcagtgatggcgatgcgtaccaatggtaattatcgttccctatttgtaccggaacaattaagcactaacacctatgaatttttgttgaaagaaccagcgatccttgatgtcttaaacttgataagtcaagcaaattgtgttattcatagtattggacgagcactgcatatggcagctcgaagaaagatgtcagaaaaagagatcctgatgctgaaacaaaagaatgcagtagcggaatccttcggttatttctttaatgaagcaggcgaggtcgtttataaaattcctcgtatcggactgcagttgaaggacttgcagaacgtgccgatcattttcgcaatcgcaggcggtaaatcaaaagccaaagcgatcaatgcatacatgaaaaatgcaccaaaacaaacatggctcatcacagatgaagcctgtgccaatgagattttaaaaggggcaaccctttaaaataaatatttttatgattttcataaggaggaaatcttaaatgacagttaaagtaggtattaatggatttggacgtatcggacgcttagcatttcgtcgtatccaagaagtagaaggaatcgaagttgtggctatcaacgacttaacagacgctaaaatgttagcacacttgttaaaatatgatacaacacaaggacgtttcaacggtacagttgaagttcatgaaggatcattcaacgtgaacggaaacgaaatcaaagttctagcaaaccgcaaccctgaagaattgccttggggcgaattaggtgttgaaatcgtgctagaatgtactggattcttcacttctaaatcagctgctgaaaaacatttaacagctggtgcaaaacgtgtagttatctcagctcctggcggaaacgatgtaccaacaatcgtttacaacacaaaccacgaaactttaacaggtgatgaaacagtaatttctggtgcttcatgtacaactaactgtttagctcctatggctaaaacattgaatgacaaatttggtgtgatcgaaggcttgatgactacgatccatgcttacacaggtgaccaaatgactctagacggaccacaccctaaaggtgacttccgccgtgcgcgtgctgctgcagcaaacatcgttcctaactcaactggtgctgctaaagctattggcttggtaattcctgaattgaacggtaaattagacggagctgctcaacgtgttcctgttgcaactggttcattaactgaattagttacagttcttgacaaagaagtaactgttgacgaagtaaacgcagcaatgaaagaagcttcaaacgaatcttacggttacaacacagacgaaatcgtttcttctgatatcgttggtatgacttacggttcactatttgatgcaactcaaacaaaagttatgactgttggcgacaaacaattagttaaaactgttgcttggtatgataacgaaatgtcatacactgcacaattagtacgtactttagaatacttcgctaaattataagatttgcgtcgtacattcatttaaaccatcgcaagagaaagcggggaagcagcgcgcttctccgctttttttaacaattacattaggaggaatctgttcatggctaaaatgacagttcaagatatcgatttaaaagataaaaaagttcttgtgcgtgtggatttcaatgttccattgaaagacggtgtgatcggtgacgacactcgtatcaaagcagcacttccaacaattaattacgtgatcgaaaatggcggaaaagcaattcttttctctcacttaggtcgtgtcaaagaagaagcagataaagaaggcaaatctttagcaccagtagcaaaacgtctaggcgaattgttaggcaaagaagtgactttcgttcctgaaacacgtggggaaaaattggaagcagcaatcaacaacatgaaagacggcgatgttgttgttttcgaaaacactcgttttgaagatgttgacggcaaaaaagaaagcaaaaacgatccagagcttggtaaatattgggcttcattaggggatgtttttgtcaatgatgcatttggtacagctcaccgtgcccatgcttcaaacgtcggaatcgcttctacaggaatcccaacagttgctggattcttaatggaaaaagaaatcaaatttattggtgaagcagtcgaagaaccaaaacgtccaatggtagcgattcttggtggtgcgaaagtatctgacaaaatcggtgtcattgaaaacttgattcctaaagcagacaagatcttgatcggtggcggaatgacttatacattctacaaagcaaaaggaatggaaattggtaactctcttgttgaagcggataaagttgagttggcaaaagaattgatcgaaaaagctggcgataaacttgttttaccagttgactcaatcacagctgctgaattttcaaatgatgttccaacagaagaacatactggtgatgttcctgaaggtcaaatgggcttagatatcggacctgaaacaattgcattgttcgctgaaacattaaaaggtgcaaaaacagttgtttggaacggaccaatgggtgtgttcgaaatgtcaaactttgctaatggtaccatcggtgtttgtgaagcaatcgcaaaccttgaagatgcaacaacaatcatcggtggtggagattcagctgcagctgcagaacaattaggttttgctgataaattcactcacatctcaacaggtggcggtgctagtttagaacttctagaaggtaaaactcttcctggattagcagcaatcaacgacaaataatcaagcaatgacgcggctgcgttgcaataagcagccgtgacccttaaataacaaaggagtgccagaaaaatgcgcaaaccaattattgccggaaactggaaaatgaataaaactgcgaaagaagcaaaagaatttgctgaagcagtcaaaacaaaaattcctagcaacgataaagtagattctgttatcggagcaccagcgttgttcttggaaacattagtaacagctgcagaaggtacagaattaaaaattgctgctcaaaacagctactgggaaaatgaaggtgcctttacaggagaaacttcaccagctgctttagctgacttaggtgttgactatgtaatcatcggtcactcagaacgccgtgaatatttccatgaaactgacgaagacatcaacaaaaaagcgaaagcaattttcgcaaatggtatgatcccaatcctatgttgtggtgaatctttagaaacttatgaagctggaaaaacagctgaatggatcgaaggacaaatcactgccggtttagaaggattgacagatggccaagtcagcaatctagtcattgcttacgaaccaatttgggcgatcggtacaggtaaatcagcagatgcacaaattgctgatgaaatctgtggtgttgtacgtcaaacagttgaaaaattatacggtaaagaagtttctgatgctgtacgtatccaatacggtggttctgtaaaacctgaaaatattgcagaatacatggcaaaagaaaatgtagatggagcattagttggcggcgcaagcttgcaagctgattcattcctagcattgttggatgcagtaaaataatttcattctcatgaaaatattgtttgcagaaaacagcttttttcactacaattaagatgttcgcaagggagattcccttaagataaaacaaactcaaaggagagacaaaacatgtcaattattactgatgtttacgcacgcgaagtcctagactcacgtggtaacccaactatcgaagtagaagtctacacagaatcaggtgctttcggccgtggaatggttccttcaggagcttcaacaggtgaacacgaagcagttgaattacgtgatggcgacaaagctcgttatggtggtaaaggtgtaacgaaagcagttgacaatgtaaataacgtcattgctgaagcaatcatcggctacgatgtacgtgaccaaatggctatcgataaagcaatgatcgctttagatggaactcctaacaaaggcaaattaggtgctaacgcaattcttggtgtttctattgccgttgctcgtgcagctgctgattatttagaagtacctttataccactacttaggcggattcaatacaaaagtattgccaacacctatgatgaacatcatcaacggcggatctcactcagatgctccgatcgctttccaagaattcatgatcttgcctgtaggcgcacctacattcaaagaaggtctacgttggggtgctgaagtattccatgcattgaaatcaatcttatctaaacgtggtttagaaacatcagtaggtgacgaaggtggtttcgctcctcgttttgaaggaactgaagatggtgttgaaacaatcttagaagctatcaaagctgctggtttagaaccaggtaaagacgtttacctaggatttgactgtgcttcttctgaattctacgaaaatggcgtgtacgactacacgaaatttgaaggcgaaaacggtgtgaaacgtacagctgcagaacaagttgactacttggaagagttagttaacaaatacccaatcatcacaatcgaagatggtatggatgaaaacgactgggatggttggaaactattgactgaacgtctaggcgacaaagttcaattagttggtgacgacttgtttgttacaaacactgaaatccttgaaaaaggaatcaaaaacggtatcggtaactcaatcctaatcaaagtaaaccaaatcggtacattgactgaaacattcaatgcgatcgaaatggctaaagaagctggttatactgccgttgtttctcaccgttcaggtgaaacagaagattcaacaatctctgatatcgcagttgcaacaaatgctggccaaatcaaaactggttctctttcacgtactgaccgtattgctaaatacaaccaattactacgtatcgaagaccaacttggtgaagttgctgaatacaaaggcttgcaagctttttacaacttgaaaaacaaataatctttcgatgattacattgctctgaaagagcagcggttgatttaacaaccgctgtgatttcagagcttttttgctgtctggattaagtgatttgaatcaagacttatttttctcatggaacagagagcagtcttttcttctttattttctttttctaaaaaaagaaattatagttctggtttagcgaaactctataataaaagaaaaaataaatttaggagaaatacatggtgtatgattatctaatcgttggtacaggactatttggctcggtttttgcttatgaagcagctaaacggggacactcggtgaaaatgttggaaaaacgagcacatattggtggcaactgttatacagaaaaacaagtcggaattgacatacataaatatggtgcgcatatctttcacacatcgagcaaaaaaatttgggactacgtcaatcagtttgctgatttttatccctatattcatgaacctattgcaaactataaaggtgagctatataatctccccttcaatatgaacacgttttaccaattatggggaaccaaaagaccagatgaagctcgcatcaaactaatggctcaaattgaaaagacaggaataaaaagaccccgaaatttagaagaacaagctctttctttggtggggacagatatttatcataagctgatcaaaggctatacggaaaaacagtggggacgaggatgtgctcagctaccttcttttattattaaaagactgccggtccggtatacatttaacaacaattattttacggatacttttcaaggcattccaaaattgggctatacagaaatgattcaaaaaatgctttcaaatccactgattgaagtttctttagaaactgatttttttgcagaccgtacgcgtcatgaagcatcaaccaagaagattgtttatactggaatgattgaccaatattttgactattgttacggggagttggcctatcgttctttacattttgaaactggaacatatgatacagataattatcaaggaacagcagttatgaactttacagacagtcaaacgccctatacgcgaatcattgagcataaacatttttgtccagttgtgacaaaaaaaacagttgtcacgaaagaatttccaaaaacttggcggaagggagacattccttactacccaattaacgatcaaatcaatcatgctctgtatcgcaagtatgaaaaattagcgcatcagcaaaaaaaatgtttatttggtgggcgtctagcaaactatcgttattatgatatggatgatacgattgcagccgctttaaaactagtcaaacatgaatttcaagcagagtgacttcttttatggaagaggttgctctttttttgtcccgattctgggacaaaacgtaacttttttactagttatgaaataatgaattgtcctatcttttaaaaataggactaggggaagcttataaaaatagttttatgaaaggggagaaaaataaacgtaatgagtaaaaagaataattatcgaaagttgctacgctccaataagagtgaacgctacaagatgtataaaagcggaaaacattgggtctatgcaacgatcacttcttttactggcattgctggattgagtatcacaccaatcgtggcgcatgcttcagaaatcacaccgcctttagatgcaagcaaagaagcaaatgccgagaacgtcttggcaaataaaacgaatgccaaaattcctgcttcatcgacgcaagaaagtgaggctacttcacaatctgaaagcatgcgtccatcggaaagtttttctgaatccgaaagcaacacccagtcacaaagtgcgacagagtcaacgagtgtaacagaatcacagagtatgagtgattcagaaactgaaaacaatgctaccagtatcgaggcatctcaaagtgtttctgaatcaatgagtctttcggaagagaagagcggatctgaatcagaaagtttgagtatctctgaaagcgcctcgatttctgaaagtggctcattgtcgtcaagtgcctcagaatcgacaagtctatcgttgtcacaatcgacaagtggctctcattcaacttcagtaagtcaaaagaaccaaccaaaacaaactgtttccgaaaaaaataaagtggagtcacaaaaagcacaagatctcttcgatcaattagtacccaagaaagtacaagcgtcggttgacaccacgacgaatgcattagaaattgttgtcaaagatggcaaatcaccaagcacatctttgattcgggcagcacaacaatatgctagtgccaataatttgattgctagttttgccatcaccacccaatcagggcagattgttaaaatcaatgtttctgcggatccagatatgggccgagaagaatttgagcaggcaatcaacgatggtaacaaaaccaattcaccttctggggtgacggttgatgttccggaccaagtgaaaaataaggaattatacaagcaaacagctattgctaatggcacttatgcagcagtgaatgactgggctacgctgaaagcagcatatggaaatgcttcgattacctatattgaggtaaccgctaatattacggcagctaccaatgtggctacccgtgatttaggatggcgggcaacgagtgtgattattgacggtaatgggtttacagtcaatatggcaggagcagcatttaatgtagggacaagttctacagttcgcggttctatctttacgatcacagatgtgaatttgattcattggcaatcaggtaccaactcaggagacagtggcacaggtaatgcagatggagtgatcgattcacgatcagcaaccggaggttatgggtactggtacttcaatatcaataatgtgactctcgaaggccgagatggtgttagcgggacagatacctcataccaaccacgacgattgctggatgcagaggacagtcacgttactttatcaggtaaagtcatcgcaaatgtcaaacaagaattgatgcaaattggtgaagtagcaatcgctaacggagcccatgtagagttgaatcggacagctggtactaccggctactccatgttttactatatggcaatccgtggcaataatgcgagtgatacaggattcaatcacacctttaaagtgggcgatggcgcgacaattattggaaacgagctaagtacctataacagcaacaactatccccttgtctattatggatttaactcaattactgtcggagatgacgtaacttggaaacaagacggtttccaaatgctactcgatttttctcgttactcgggaagtcaatcaaatgaccgaaccgcaacttttggtcaaaatctgcaaatgacggcaactcgtacagtaggttccaactcgctaaacgtcacgaatagagcggttgttacatttaatgcaggaacggtacttgatctgcaacaatggaatgccaacactgttgtgaacgtggcttccggtgcaacagttcgctttatttcaccgcgggcattgcacttagcccgtctaacttcttcaggagctgtttcggcaggtcgattgattaccggttcgggaacatttgtcatgaataattctcagatcagtacatggcaaggcagcagtagccaaaccgctgctccagaaggcaaccgtaacttaaaattcgtggaaatgactatttcaggttcgacaacaactattaaagatacggctggaaatgttactacatctaacattgtagacacttctacccgtgaattagcgactgttgcgattgcgccaggaaccgtaaccgtaaattatgttgatcagtacggcaatattattaaaactgttgatatgccaattgatccagacgttaattacattggtgagtatcttgatttgcaaacattggagtatgccaatgagttaatgcctgaaaattatatgtgggcaatcggtacccaagttgctagttcagctaaaaatgatggtcaaagcggcggagatagtacgactaatgccgataatggggacagctatgggcaagcgacggttgcgattgttccaatggagaacacaaattatacttataatatttatgtatatggtgttgccaatcattcggttcagtaccaatatgtcgacgttaagactggtcaagtaatctcttctgagtatatgaatgctggtaccgaagcttccggaacagatagaattcctgcaaactacgggaatgttatcgattggacaaatagttactatacttcgactaatttgccaccaggttactattatgcaacaggtgccgtattgaatggcaatgtacagcctggatctactacagttggaactgaagcgagtctgacaaccatttacgttgcagcagacacacaaactgtcaatgtaacttttgttaattcagatggccgtccattacaaaaccaagttggcacagttgctatcaatgggacgactggtcaagaactaagctattctgacttaatcgcagattacctaactcaagctggttattatgcagatcaaactggaacatttgtttttgatagtactagtaataatggcagtacaacagacagtgatcaacaatttattacgatcactctttatccatcctatcaagaagtcggtgtcgttggtaataatcaacctgaatcagatcctgctacaggggaagcatttgagcaaatcccaggaactgtcactgttggaaaatatggtacttccggtgtttcaaatgaaagtttcactcttggggtgacagatgcagatttagagagaaatgggtatatctatacggttacaggaccagatggagtagtctacaatacattagcggaagctatggctgccaatcaaacttttgatactaccagcaatggagcatctcaaacggattcttcgccacagatgtttacggtcaattatgaacaagacccggtatcattgtctacgtccgagtctatttcgggaagcgaatcattatcagaatccattgttacttctacttctgagtcagaaagtgtttctctttctcaatcaatttcagaaagtgactcattatcagaatcgatctctgttagtgattcagaatcaatttctacatcaattagtgcgtctgtttcagtatcagattcagagagcaactcagtgtcattgtctatttcagaaagtgaatctgacatgaatgactcgacttctgaatcattgtcaacatcaatctctacttcaacttctttaagtgattcagaatcggtttcgatttcattgagtgactcagagtcaacgtctctttctatcagtgaatctgtttcggtatcagactcagaaagtggttcgttatctacatctatttcagaaagcgaatcaatgtctctatcaatttctattagtgattcagaatcgttgtcagaatccctatctgaaagtatttcaacatctatttcattatcggatagtgattcaatgtcagaaagcctttcggcatcagaatcgttatctatatcagctagtgtatcagagtctgattcggaaagtgatagttccagcttaagtgcgtctgtttctggatcattgagcaacagtacaagtgattctgaaagtttatctttatcagagtcagtatcagtttcactctcggaatcactaagtgaatccacgtcactatctctgtcagaaagtgactcagtatcagaaagtatttcagcatcagaatcattatctgtcgctatcagtgaatcggattcttcttccctcagtgaaagcattagtttgagtgaatctatttctgattcgttgagtgcaagcatgagtttatccgaaagcttatcggagtcagaatcgatctcaaattcaattagtacgtcgatgtcattgagcattagcgatagtaatagtgagtctagtagtgaatcagccagctatagcggcagtacgagtgtaagtaatagcgattcaacaagtgaaagtatttctgcaagtaattcactatcagtaagtatcagtgagtcaaccagtttgagcacatcaatcagtgattcatcctcattgagtacaagcatttctaactcactaagtgcgagcgaatctgcaagttacagcagtagtacgagcgtaagtaacagtgattcgacaagtgtgagtacgtcagttagcgaatcaacatctacaagtatcagtgactcaatcagtgccagcatatcaactagtgattctttatcggtaagtattagtgattcaacgagcttgagtacctcacttagtgattcatcctcagtgagtgtcagcgtttcgacatcactaagtgcaagtgaatcaacaagttacagcggcagtacgagtgtaagtaatagcgattcaacaagtgaaagtatttctgcaagcaattcactatcagtaagtatcagtgagtcaaccagcttgagcacctcacttagtgattcattgtcattgagtacaagtatttccgcctcactaagtgcgagtgattctgcaagttacagtggcagcactagcgtaagtatcagcgagtcagcaagcttgagcacatcaatcagtgattcatcatcattgagcacaagtatttctgcatcattaagcgcgagcgattctgcaagttacagcggtagtacgagcgtaagcaacagtgattcgacaagtgcaagtacgtcagctagtgagtcaacatctgcaagtattagtgactcaacaagcataagtacgtcgatcagtgactctatgtcattgagtacaagtatttccacatcactaagtgcgagcgattctgcaagttacagcggtagtacgagcgtaagtaacagtgactcgacaagtacaagtacatcaatcagcgattcgttgtctctgagcacaagcatttctgcatcactaagtgcgagcgattccgcaagcttcagtggtagcacaagtgtaagtaacagtgagtcaacaagtacaagcacttcgatcagtgattcattatcagtaagcacaagtatcagtaatagtgaatccgcaagtgcaagtacgtcaatcagtgattcatcctcattgagtacaagtatttcggcatcactaagtgcgagtgattctgcaagttacagcggtagtacgagcgtaagtaacagtgagtcaacaagtacaagcacttcgatcagtgattcattatcagtaagcacaagtatcagtaatagtgaatccgcaagtgcaagtacgtcgatcagtgattcatcctcattgagtacaagtatttcggcatcattaagcgcgagtgattctgtaagttacagcggtagtacgagcgtaagtaacagtgagtcgacaagcgaaagtacgtcagtcagtgattcattgtcagtaagcacaagtatttccgcatcattaagtgcgagtgattctacaagctacagtggtagtacgagcgtaagtaatagcgagtccacaagcgaaagcacgtcactaagtgattcttcgtcgctaagtacaagcgtaagcaacagtgaatcaacaagtacaagtacgtcgatcagtgattcattatctgtaagtacaagtattagtaacagtgaatcagcaagtgtgagcacatcaatcagtgactccatgtcattgagcacaagtatttccgcatcgttaagtgcgagtgattctgcaagttacagtggcagcacaagcgtaagtaacagtgactcgacaagtacaagtacgtcgatcagtgattcattatctgtaagtacaagtattagtaacagcgaatcagcaagtgtgagcacatcaatcagtgactccatgtcattgagcacaagtatttccgcatcgttaagtgcgagtgattctgcaagttacagcggcagcacaagtgtaagtaacagtgattcgacaagtgtgagtacgtcgatcagcgattcgctgtctctaagcatgagtatttccgcatcattaagtgcgagtgattctgcaagctacagcggcagcacaagtgtaagcagtagcgattcaacaagcgaaagtacgtcagtcagcgattcatcctcattgagtacaagtatttccgtatcacaaagtacgagtgattctgcaagctatagcggcagcacaagtgtaagtaacagtgactcgataagtacaagcacatcgctaagtgattcattatctgtaagcacaagtatcagtaacagcgaatcagcaagtgtgagcacatcaatcagtgattcatcctcattgagtactagtggtttggtttcacaaagtgcgagcgactctgcaagctacagcggtagtactagtgcaagtattagtgaatcaacaagtacaagtacgtcagttagcgattcgcgggctagtgaaagtcaaagttatagcagtagtacttcagccagcttgagcctgagcgcaagtgtcagcacttcagtcagtgattctgcttcaattagttcaagtatcagcaacagtgaatcgaatagtatgagtacgtcaatcagtgattcacgttctagtatgagtgaaagctatagcagcagtacttcggcaagtattagtcaaagtactagtgacagttctagctacagcagtagtacctcagcaagcattagtgcaagcactagtgatagtacaagtattagtaatagtgcttctgtaagtatgagcgaaagtttgagtatcagcacatcaataagtgactcgttgtcaatcagtgcaagcttgagcaatagcgatagtctttcagaaagtagatcatttgcaagtgaaagtcaaagctacagcagtagtacttctgcaagtctgagtctcagcacaagtactagtatttcattgagtgattcatcgtcaactagcatgagcaacagtaccagcttgagtactaacttgagtcaattgacaagcgactcgctttccgaagggattagcttaagtaatagtctaagtaatagtttcagtaatagtacttcagctagtacgagtttgagctcaagtacaagtctaagtgaacaactatctcaatcagtaagtgccagcgagtcacggagtgatagcgtcagctatagcagcagcacgtcaattagtacgagtgaaagcagcagtactagcttgagcgaattactatctcgttcagccagtgccagtgagtcgcggagcaatagcttaagtcaaagcacaagtacttcctttagcggaagcagcagtactagcttaagtttaagtgaaatgaactctcaatcaacaagtgctagtgagtcacggagtgatagtgtaagcaacagcatgagcacttcaatcagtgatagcttgagtgcaagtactagcttaagtgatttactatctagatcagagagtgcgagtgaatcgcgaagtgacagcctgagctatagcggcagcacatcgatcagtaacagcttaagtttaagcacgagccaaagtgatttagtatctagatctgaaagtgcaagcgaatcacgtagtttcagcacgagtgatagtgctagcacatcgatcagcaatagcgctagtgcaagtgacagcttaagtgatctatattcaagatcgaatagttctagcctttcaacaagtgacagtacaagtaccaatgattctgtctcagcaagtgctagtgaaagcactagcacctcacaatcaattagtacgagtctaagcgaatcggcatcaatcagtacgtcgcttagcgaaaaacaagaagtgattgagtctcaaagtgtgagtgcttcaacaagtgattcacaaagttcgagtataagtgaatcagttagcgtcagcatcagtactagcgaaagcgagcggaatagtacggtggtttcacctagcgaatcaacttcgattagtgaaagtattagtacgagtgaaagtttccgagattctgaatcggttagtgcaagtgacagtacaagtttgagtcaatcaatgagcactagcgaccaagtctctgcttctgagagtataagcgacagctccagcactcgtgattctgagtctgaaagcgcaagtatttctacggaagaaagccgcagtttcagtacaagtgagtcaatttctgcaagtgaaagcacatcgattagtcaaagcgaaagtgcaagtatgagtgaatcagccagtgaaagtacaagtacgagtgatagtgaacgtgattcaatgtcgaatagtgcaagtgtaagtgattcgaactcaacaagtgaaagtctaagtgtgagtgaatcagctagcgaaagcacaagcatcagtgatagtgaacgtgactcaatgtcaagcagtgctgagacaagtgaatctggctctacaagcgatagtacaagtgctagcaactctgctagtctgagtgaaagctttagtgcttctgatcgggactcagtctctatgagcgcaagcgaatcaatcagcgaaagtacaagcgttagtgaatctgcttcgttaagtacaagtacaagtgatgtcaactctgaaatcgtcagtgactatcatagtaatagtttgtctgaaagtctttcagaactacaatcgcaatcaactagtcaagatcattcactttcagaaagtgcatcaatcagcggatctacttcaactcctacaaattccgagcagaataatgcaacgaacggaaatacaggaacgtcacaaggcaacataggagtggggggacatgcgactggagccactcttcctaagactggtgaatctgatgcaagcggtagtcaaatgtctcttgctggaattgccgcgctgttagctgcgattgctttaatgaaaaagaaaaaagatgcagcaaagcgtgaaacggattaatcagttcctttcagtttatgaagggctgggataaatttcctagctcttctaaaatgatagaagtgttactactcaataaaaaagcgtcacagttagattttcctaactgtgacgcttttttattcgctatagccgattatggaaattcaacatcgaatgaaccgtcttctgtttttaccaactcggataataataaatttctgattgcttctagataaattgcttcacgcatttgagtgaaagaacggtgtgcctctacttgaaactcatagatgggacggtgttgtccccagtttcttccattgatgactgttttcaattgttgcaagttgtctgattgttcgatccaaagagtatccaacgcttttaaaagaacaattcgcttgaagaacagctgctggaaactgtctggcatgaattgctgaatgtgagtcaaacgatctgaaatcagagctaataagaattttttgacggttcgtttattaaatttatccagtttctcgatttcaaaaatatcaaaattatagtccaaattattaaagatgaaatcaaggatcgcttgtttatttagattctctttcttagtgatgaattgattgattgcttcttccatgcatttgttgaagattttttctaactcaactggcgtgcctgtcatgatactgttcctcatgctgtacattttgtctctttgaatggtgatgattgagtcaaattctagcgttgtttgacgtccagcaatttcttgatttttgcgattgctttgagactgattgatcaatttattgtattttttcttttttaatggcttgaaaccattggctgatttttcttgttcagttaatagttctcgttcctgggctgcccatttaggtgcactttcaacaacgattttatcctccatggatacataaaaaatgctatcaccagggcctccttgacgtccggagcgcccccgcagctgattatcgattcggtcactggtcattcgttcggttccaactactaacagaccgccgttttcccgcgcgtcttgttcaagtttaatgtctgtaccgcgtccagccattgaagtggctactgttacggccccttttttgcccgcttctgagatgatccaggattctttggtcgctgttgtagcatttaaaaggttatgaggaattcgatgctttaagagaatcagagagtataaagtcgacattgagaccgatcctgtttcaatcagaacgggacgttcttggatcaaagcattttttactgcttctaaagaagccatgatctttgactgattggtaacatatacgaggtcctgatgatcttttcggcgaatgggtttattcgttggaatttcgattacgtcaatattataagtttcacgaaattcgtcagcgtctgttttggctgtcccggtcattccggataaaatcttgaattttcggaagagattctgataggtaatggagcccatggatcggctttccgtggtgatctttaccccttctttggcttcgattgcttgatgaagcccagcttgtagttttgttccgatcaacttgcgcccatttgcttcgtcaagtaaaagaatttcattgtcttccacaacatagtctttgtttaagtgcaagagataattggcccgcaaggcaatgactaaatggcggtaaagatttttccatttttctgaaagaatgttttcgatacctaagtagtcttctgctttttgaatacctgtttctgtaaaccagacgtggcgcttattttcgctccttaggtagtctttcccttcaatcaggctctttacaaaccagtcagatagcgtaaaaaagttggactggactttgggagctcctgaaatgatcaatggtgtttgagccatatcgagtaatattgcatcgatttcatcaatcagtacataattgaagtgggtaacgtattgttcatctggagaaacggccaagttgtcaaacaagtagtcaaatcccaatgcgctatgggtagtatagacaatgtctgctgcatagacgacctctttgtcgacttcttctccttcatcttcatgttcggggactccagcagccacggttagtcctagaaaacgatagactttcccggtttcttcaatatcccgcaatgctaaataggtattggaagtaatcaaaaaatttcctttgcctcccagaccgtgtaagtacatcggcatggtggctgtcaatgtttttccttcaccggttttcatctcagcaacattgccataaaaaagagcaatcgcgccaagaatttggacaaaataaggttccattcctaagacacgacggtctgcttcgacaactacagcataggcttgtgggagtatactctctaacttttttcctagttcgagttgttgacgaaaaagaatagtttgcatttgtaattcttgatccgacaattgccgatacttgtctgcgagattttgaacctttctcgctaaccgcatatatttgcgaaattttttatctttcatttttgctgatccttccccaaaaaattgatagtgttagcagattaatttgtgttactggctaatttagcacgaatcattacgtcctctagttcaaaaagataatcccgcatcaaatcattggcttctaaaaaaaagacgatttttcccttcggagcagctagtttcatttttttggacgcaataagtggttccttgttttgatcaagcaacgcttcaccagaacttgttacgaagtgaagggaaaacgtataggttttggtggtgtccatattatagtagggaaattccccatgatagatggactcttgatcagctacctccaaagtatcttcagtccgtaaaacgacagctttcaagtctaatctaggactaggttcattgtcaggagtccttgattctgcagtctgtgtttcattattcgtcaaagtatctttcaaaaaaaagatacctcctaacagcaaaacaagaggtatgatgagttcaattagtttcttcatatgaaatccttctttttggggatgtttctacggaattttctccccttttttttccaatcctcgtcattctcagatgatcatctaaaaatgaagcgttgttttcttatttgaatttaaaacgatgataccacaatgactaacaccaccttttcattttttttttcgtttcaacaaaaaaacaaataaaaaagggggatttaaacttgctattattttgttaatccttacagatgaaaaaagtaagaaaaattggagatgaaaatgaagaatcaaaaagaactcattcgtaggatcatcgcgagtttcttcctgttgttcatcgttgagataggaaagcatattccgattcctttttttatttcagaaaagataccagaggaatcaactagcttgattctgaaattcttagcaacatcaaccggtggaaatttcactgttccaacgcttttttctttaggaatgggaccgtatatgactgctctgatcatctggacaacgatcagcatgattgatacagaaagtatcggaaatctttccacaaaaagaatcggctatattcaacgttgtttgactcttttatttgctgtccttcaaagttgcgcattagtgttaaaatttcgttcatcaatgatcgatcaaaaagctgttgggggatccgttgtcctgttgtttttaggagcagtccttattttgactgctggaggattgttcgttgcgtggctagccgatatcaatatcgacaaaggaatcggtggtcaaagcttgtttatcgttccaggtctattgatgaacatcccagctatgttaatttcgggacaaacagaatccgtccacttgagtcaaaattttatgattggtttggttatagtgactttaatctttatttatctaacgcttttcctttacagtgcagaataccgcatcaatattgaacggacaggtattgatagtcgcttcaacaattcgtatattcccattcgtcttttgcctgcaggagcgatgccgtttatgtttgcggtaaccgtcttttcaatgccgcagcttttactcttgaatgaaaagtggggagacacaggcttttcgaattttattacgacttacttttcatttaataatgtgcggggtgttttcacttatggtctgattctctatgttttaggttatggatttagttttattaacgttcgaccttacgatatagccaaaaatcttaaagagacaggagactatattttaaatattgcacctggtaaacagacggagatatatatattgaagcgattatctacggttgcattgcttggcaacagttatcttgtgatcatttcaatgattccgttattgattgggttgcaaaatcagatcatttccaacttagctttttattttggaagtatttttatgttgatcattattttagaaactatcacaaatgaaatacgcttcctcttttccagacgcacttaccggattttttagaggatgttaggaggtaattctttgaattattttattcccgattggacgaccagcagcggcaatttagaaagtgactacatgatgaatgtcattcagcttttcaagaacaatcgagaaccgtaccacttattgttattggaacatatcccgtttttgcgctataaaatgcatgcgtatgggttagaagcagctcagatgacttcgctttacgatcgcttgcaagatattcacaagatcaatgggtttcctttagatgtagatgacttgcctctttctcacaatgtggagaaagtctatacgccttttggtattacgttgatcaaggaagatcaaccatttggtaaaattcgtttcaatgcttttggctttgcggaacaaatgtatttaatgacggacccttaccgacaaattctcttcttcgatgatcgaggatttatttctgcaaaatcattgcagacagacaatggggaacaagtaaagaggatttactataacgaatcgggaatggaaaaatgtgtggaatactttggagaaaatccgcatgttgagctgattgattctcaaagaattggactaaagaaaagtcagtatcgaagtatggaggatcttctcttagaaatgatgaatcaatttcaatggaatagtgaatccgaagatcaactgatctgtttgacaaatgagcggaatctgcgattggtcaaaacgaatgagcaacgaaagcgagtgattcagatcgtttctgatgctcaccaactttcaaagtgtgcaccagaggaaaaagcagaattgtgggcagccgaaaataaaattattactgattccactagtaatcaaacagcgctcttgtctttaatgagacattccggtgtcaatgacccatctcgtatacagcgcatacctatttacacaacttctttccatctaggcaatagcaactccattccgcagctggttctttattggaacgccggtgagcttaatgaagacgttctgagaatccatcacttattgctgcaaaaagtcattcaaaatgatcgttatgacttaattatcgaaacgacgacattccaaagcgaagtcgttttacgtgaagcacaaaaagaaatggttgatactcactttggtgtcgatagtgaatctgaggagtatcagaaggtactgaagtattttgaagcaaaaaaagccaagaagttatttaaaacagatgaagaggcgattgaagagattcgagaaagcgaaaactggagaaatctggtagaagtagttgatgtcaacttcaggattcactttcgattggattctcacctcacgacgattcgacaggattttaatgagacacgtttgtatattgatttgtctgctgaagttgatgtgcagaaacaagcattggcagtaagcgcaggaattcctcagctcgttcggaagaaaaccgattatgttgatgaccaaaagaatgggcaaatcattggtcaaatcagagacctagatccagcaattgctttttatatggatgatttaaacaattggaaccaagcactagtagaaaatatcagttatattgaacgatttagcgaagaaaatgtcatcaaacaatggagggatctgctctatggcgtcgtctaaacaaataaagatattccatattgcggctgcagctgtttcttcagagtggcaaaaacagctttcttctttgtttgtttatcaatggcttccgttagcctatgatttcagaaaagatgagcaggaactgcagctgttcgagaaagacaaatataacagcaagtaccatcgagccctttttctactagagaaagatgcgttgattcttgaagacaaggagctattggaacaactgccagcctatcaaatcttttacgaaaaaaactgtcagctgtctcccgaagttcaagcgctcttcacattaaaagcagcaaaactgtttgatgaacaacagttggaaaatgtttttagtagcatcaatgaacaattttcagcgaagcagcaaggatataagttatcgatggatcacatgaaatttaataaagatgtatcgttgcaaatcactaaagaaggacatgcagcttgtcaggtaaaggcacaattgacaccagattatcagcaaatcactacttggaaaatgacgaacctgatccctaaagaggaacggacatgtttttatcccgagatcgcaaatatccaaggagaggcgatactgaagatcaaactttttttcatcaaagaaaacacaaatcaggtcattcaagtgattgagatcgcccacgatcgcatcataaatggggatccgatttacttcaaattggatcaacaggcatacatcaacgtttcattgtatgccaaaggaaatcaaggacaatttacgatcggacaaatgcacttgcgacgagcaatggcagatgaaagtgtcatgattccagggggcggccggatccgggatgatgagcatctgggcggagaagtgatctattactttaatccaggagacctaaaacctccattagcggtttatttttccggatatcgctctgctgaaggattcgaaggacgtggaatgatggggagcatgggctgtccttttttgctgattggtgacccccgtctagaaggaggaaatttctatctaggcagccagaaatttgaacaagaaatcgtaacaatcatattagaaaaactagcattgttgggatttcaaaaatcggatctcattttgtctggattgtcgatgggcacttttggcgctctttattatgcgagtgatttgagtccaaacagtgtcatcgtggggaaaccgttgacgaatcttggatctattgcactcaatgaacgcatcaatcggccaacaggatttccaacttcattggatatgctgctttacaatattggctttgtttcagaagaagcaagtagtcaattgaatggacgtttctgggaaaagtttaaaagtggagactacaggcaaacgacatttgctatcgcctacatgaaacaagacgattatgacatggaggcatttccaatgttatttgaatttctaaaaaacaattttcccatgactcgtgttctatataaaggcatgataggccgtcataacgacaatagtcccgctatcaacaattggtttttgaaacaatacaagaatattcttgtgcatacatttcatcggaatatcaagaaaattttataagaaatgggggagtcgatgaatcgcatgtaccgtatcaagtgggggatcgactttaatgataattacaattatggcgcaaaaatagcctacacatcctctggtgacgtcgcttattcttcacctctgatgcctcctggcgtcagtattaagtcctggtattcgaaaacagaatttcacagtagtcgaaaatcacctatgttgccgatgttgctgcctggacacgagtacgagttaacacttcatgctgaattcgatcgtaaagaagcagtccagctgctggtggaattttttgataaagacggcttttttcttgaaaaactggtcttcgaaacaactcaagagagcttccgttttccacaaaacgccactgattaccaaattcatatggtaaacaaaaagcaccaacagattctttttaaggaattggttttatctactaaggagaaccaagctttggcggtggttcctataggagcaaactcaggaacaaacattgttgcagttactccgttggtgggggaaagtgctgcattatcggtcgtattcgaaaaacagaatagttatgtcaaagaatattcacttcctgattgtgaagcgggattatttattgaacccggtgttacggctgcttcatcgtttttggaagttttgcttgaacaaatctatcagcgaatcgataatcctgatcaaatcacccttaaaatgggacaaaatttttctttactggaatcctgttatcacgatgatttttctatactggctttattatttgcaaaaccaaacaaagaaactgagtcaactgagcttatgcatcgtttgcagaaaaaaatcgtacttaatcgaagggcactgaatgtattagaaaatttaaaagaaaatagaaaaaaatcaacctaaataaaagggggacatcatgaatttttttgtaaataaagcaatgggaatcggcaattctggtgtggaacatgcacagttctaccgtgctgcttgttttgatagaaaaaatattccgtataaatatatttttatggaattagtaaagaatcttcatgaagcgatggcagcttggaagataccagacaataaagtcatctccatgtgggaatattttgccctagaaggtgactatttaagacaaggagctaaagcgaattttaccgcgaaacaggatctcttggtagacgccacgaacacgcataggattaaagaaaccatcacatcatcaggattgaaaatcgttgagcacatggaaaaatcccctagccgaaaaaaagaagggttattgctagtttcagattatcgggtagagatttttgactatcgaacgaatcaaagaaaaatcatgtacagctatcgcaatgatcctcatcgaggaagagtgatgacgaatattcacttgtttgcttttaagggcaaacatcgcttctttagaaatgaagtcttgctgcaacgctttttctttaaacaattgatggaagagttcccagaaaccaaaactatcatcattgatcgaggagaagaaagtgaggccgccttatatgatcattgtcctccagaaatcaaattgatcgaaatagtacatgctgatcatttatctgatcgtgatgtacctcgtgcgcctctttggaacaattattatgaatatgcattgacgcatttagagcaagttactcacatcgttgttgcgacagaattgcagagacaagatctactgatcgattttccaaacgaatccgaaaaaattgtgacgatccctgtgggggggattcgcgatatgacagaagaatcatttgaaaaaggcaaacaacaggcggagaagtttgtgacggtctctcgcttggcatctgaaaagcacattgatcttgtgatacgtgcaattgctgcagcaaaaaaagaacatccaacgctctctttagatatctatggtcaaggcggagaagaaagcaagttgaatgcaataatcaaggagctaaatgcagaagaatatattcaattaaaaggccactcccatgcgatcaatgaggtatatcccaattacgatgcctttatttctggctctttttcagaaggatttggattgacctatatcgaagcattgaatgcgggattaccaattgtgacgtacaaggcacgttttggggcgatggagttgatcaaagaaggggtcaacgggtatttgaaagacttttccagaaatgatgatacctacaatgtccagcaactaacagaaggaattcgtcagttagtcgctactgatttaaaccaacttaaagccaacacccgcaagtctgtccggatgtttcaagactcgataattgcagagaaatggagtgagttgatcgatgcattatgaattagtcactgtgatccgacccaatgaccggatatggatgacacaaaaatcacgaatcaaagaaggaaaccaagtgttgtctatctcaccaagtccaaattttcaagcgatgcttcaaaaagaagcggtgcagggaataaatattttagatcaagtcacacaacggagccacgatccagaaacctttttattttttaaccaagtcccaacggcttattgtacagaagtctatatgaacgaagatcgtaccatttcgttgattacagacggggatgaaataggcaaagtgagcttataccctatgactagaagacatgtcaaagaggtacggtacttctatccggatggtacgatagacttcattgaagaatatgccgctgacgggaaattgttctcaactatttattattgtaacgatcaggtccaagagattgcttttttcaatgatcagcagcaaagcatcttgaattattacttttatcagggagcaatcaacttggtcacgattcgtgatactgcaacattgaaggtaacccagaaatttaatacaacacttgatttcattcgggaacagttagctttgcggttaacagaaaatgataccgtgggaatttcatacatgggattagaattgttcgctttagcaacatctaattcaagaaataccctgtatctagaagagtcgcctcttgatggcaaagggaatatcaaaggaaatttaatgagtattttagatgatcacatcccttacatccatagggtggaagtggatcagaagaattatcaactattggcaaataagaatgtttgcatggacaaagttgtcttgaaaggatgaagacgaaatgaagaaaatgaaggtcaatgaattgtatgagcaaatcatgtcattaatcaaagaaaacagcggatccatgctctcttttgagaatgagcaggaggaagcaaagcgcatcctgcatcaacaaaaagaattgattgatcaattgattcagatcaatcaagagatgaaagcaatgatcaataagtcagaaaatgacatcgatctaaatgagatccaagcgttaaaaaaacaattcaatgcgtcttttgagcagcaacaggaagagcaaaacagattgcaaatgatttatgaaaaactcttttctgcttacgaggttgaaaagcaaatgcttcggacgtatttcttgaatgaaaccgatcagatcattgatatgttgacctcaaccgtagaaagacaggatagcgaagtgagtcaattgagtcaagagctgattcatgaattgcgttcattagaagaaacagaagtagaagctaatacaggtgcagaggaaaacgaaccaacagaaaacgttgcagaaatgagtgagtcgctatagctggcaactgatcaaatccaatagttaaacactgtattcttcatagttgttagctggaaataaactggggagaggtgatttcgttggcaaataatcagttagataaaacgattcaagcaggatttcaagaagaacgagaaaacgtaagagatcactcggaagagaaaaaaaagggaaagctgtcaccatcgtgctttccttggttatgtcgatcgtgatccttggatcgttggtctattctttgttggaagcattacagaagtaaaaattggaaataggtcctgcattttagaaaaaaggatttgaaaaatatggaaactagattactaagcgtttgtcgattaatcagtacgatcaacccagacttaaagatacctgatacatcagtagttgctgtcaatattgatcgcgagaaattagaagaaatccgcaaatgtaaaggtctatctgttaagtcttttgaaagaaagattgggttatctcgctcacgatactataggtgggtacaatatgaaatcgacctgcctttcgaaatggttgttggaatcaagaaaatgttgagcatatcagataccgtattgttagacatgtttgctatgtcaacagatgaacaacttcatctattaagtgtactgatttatagctctttatcaacgaaagaggacatgttcgtcacctttctcaaagtcagaaaagagttagaaaaatttcgtcctgctactgaggataatgtgatgtttaaacttatgctggcctattctgacctcgtgttcggctgtatgaaccagaaagtcccacaagcaagtttagagatgcttgaaacattttttctcggaactgatttttatacattgtttgatagtctcttatatttggctacgttgcgcatcaaacatcgctatggattgcaatcctcttctttagaaaaacaaatgtttctgttagaaagctgtctattaaagaaaataaatgcaactgactttactgaactgcgaccagttttagtaggagccgtattggatttgtcggaatgtttggtagatatgcaacgctgtgaagatgccattcaattgcttcaacatgcgagtcgtttaatggaagaacattggcatattgatgtctacaatcaaacggttctaaagctagtcaaatatctgatccttacaaggaatacttcgcaagaagatccagctgtgcaactgttttccaaaaatttgaaaggtgcagaatggtgcttaccaaaagatgaagtgatgtttgtgcgagcaatgatggaaaaggagatggggcaagcgtgaatcggtgggtgacgacgatcattgaatcgaatgcagcagattcagtcaaaaaggcgaaagcagatgtttgtgacattgccaaggggatggattatcagcctttatatatttatcgttatatcgatgagaatgaagatgattacgcacttacctcgaggattgatggcattacagctggtgttgccaatcaagatatggtggtctaccaatatccaagctataatggtgcccatttcgatcggatgtttttacaaagaatgaagcaaagagggatctatacgatcttattcatccatgatgctgagatgttgcgagggaaagtcgactttgatgaagctgctcttttcaacgaagccacattattaatcgttcatagtcaagctatgcagacagctttagtcgaacgaggagtgatccgaaaaatggtccaaaaaccgttttttgactatcgacacaaggaagtaagtgtcagtcatgagcggccagaaaaacgagttgtctttgcagggaatttagcaaaaaccctttttttacagcaatggcccaatcgcactgaaattctcgtatatggtgaaaagaatgatcgcccttttggcgcaaatgtccattattgtggtgtatttgagcaagaagaattgattcgcaagatggagaagaatggctttggtcttgcgtgggatgacaaattgccagctggtggtgactatcaacagtacacgaagtataatgcgcctcacaaaatttcattgtatctctcattaggcatccctgtcattgtatggcaacaagcagccatagcagagatggtacagaaactaggacttgggattgttatcgctgggattgaagaaattgaccataaattaggtgagttaacagatgaagaaatgctgcgaatgaagaacaatgttctttcatttagttgcttactgcgatcgggaatatttactaggactgcactagtggattcagaagtaaaaatactcctaaacaaaggggcaaatcaagaatgacacaatcgatgatcacaaagaaattatccgcaatcgtccagatcagcgagctagaccagatgctagcagagatgaatcaaacgatcgaacaacgggatagtaaaattgagcgattaaagcaaatgatctcagaaaaaaaacagtccaccattgggtatcgcgatttttttattctgaagaactgtcaagatgagctgagagatctctgtcaaaaaattgacttgcagcgggtcaaagtcaatgatcttttggaacatgtacgcaatacaaaagcgattttcaacgatttgttttttttagaaacagaagtcaacgaacaggcgaagaaaatacaagaactgtcaaatgcattctttattcaagcggagacaaaagagtagcggctgaaacaacaacagaatgtttggggagcaagaaatcatgacaaatagggaagttaggaggattagtgtggacaaaatcattgcattagacattgatgaatttcgagtaggcgtcgttggctatggttatcaagatgtcagaagttctgtttattcagaagtcaaaaaaaataatctgcagtatcttttaggaaagaataatgaaccgacccactccaaaaacaaagttggggaacgaattcttctcgggggaagcgagcaagaaattacttggggcttcgacaagttatatagtcgacgttcgaaggcttaccaaacctttggaaatccattggcagccattggagaccaaaattttaagacatatatcaaaacgatactttcttatttagtagagaagagaaccttgattttcactgaaattgcaaaggattgctttagctgctcattgtgcattggcgtagcaacagaaagttttgaccagctggctgaaatcgagaggcaactggcagatgaattcgagacagtcgttaatggtacccactatcggatacgaatcgaacgagtaaaactgattcccaaatcgctggctgtgatttttgaaagtaggcgaaacgatattcatttaatgttaggcgttgaagaaattctggcgggattgacttatgtgtttgagattaatgatcattatctaacttgtgacagttatgaaaatggcgaactgatcaaaagtacaaaagttacagacggcttgtatgaattagccggcaacgtggtacaagcttaccaagaaaatgagggaaatcatcccacgctaacttttgatttggatgctggggtaatctacgatatgctggtcacaacgaagaagaacaatccatttattgtgacgatcaatggacgtcagaccgtcgatttaaccgaaatcgttaaaaaagagctgacggctttgacggatcaattcattgattatgtcaatagtgatcaggatgttcaatatgcggatacaatactgatccgggatatttctgcaggaacgatcaatgaaaacacagtgaatcaggtattagctaaaatggggctatcttgtaaagtgtttaataataaaaatgcgctgggaatgtatttatttggggaattgttctggcaagaccaaccgaagactttggctgatcgctttgaggatagccgtccatcagctatgaatcatggtttttcagaaccggaagtgcgtgcagaatctgcaccaatcgaagagtacgtcgaatcaactaaccaaattgattccgagctatcagaagttaccgagcaaaagagtcattatcgaagctcatctgtggaaacaatttttgcagaacagtcagaattgcttaaattcttgatcaatgatgacaaggagccttccatttagcaatgaaaaagagaattttgatcgataaacgatcaagattctctttttcttgtggttggatttttttgcttaaatccgatactcgaatagggcaagaattggtcatcggcaatcatctatcagccaaactgtcgcagatgaatgaaggatcattctgtgctttaatcttcttcggaggtttactccttctgattgctggtatcttcagctaccgtcaccgtaaaaaaaatctttggggaaaatcaatttatctggttcagaaatgttttttctcaaaggtttttgattactggttattttataaggacacctaaaatctgtttaaatttttggctcatttgctgtgcagatggtacactagagtcaagggagggatcctatgctttggctgataattgtacttattggactgattgctgggttatactatatttaccgaactgcagtcctaaaaaaaggtgtacgttattttgtatctgctctgatcatgcgcaataaccattggtatgaaaaagaaggcagaaaacaacttgttccttcgggacagcgatcacaggaagcaccttcaactttctggcaagaagggtccgaatgtacccttactgcaacggatgatgttctgttacatgcacgggtctttgatcagtgtgccaaaacatgggtgatttgtcttcatggctatcgcagttctggacaagtcgattgtcaagatgccgcggaacgcttgtggcaagccggacacaatgtcttagtgccagatcttcgcggacacgggcaaagtgaagggcttcaaatcgggttaggctggttggatcgcttagatctgattctctggatcgagaaattagttgaaaaagatgcgcaatgccagattttcttgtatggtcaagggatgggggccgcaacagtcctcttagcgagtggagaagtattgcctattcaagttcgaggattgattgcagacagcagctatacctcgatctatagtttgatacgagccaatttaccgcgtctttctggattacccgtcaaacggttcctgcgtatggcaaatcgttacagtaaacaattagtagggtacccatttctacagatctctgtcacacgccaactaggcagtaaccatttacctgttttatttttacatggttctgaagatccatttgtctcagcagaagaaacagacacattgatggaagcaactgctggggaaaaaaaacgagtcatttttccagagatgggccatcttcaagcggtcacagaaagtccagaatattggccgactattctacaatttatccaggcaacagagtaatagtgcatttgaatttttttaactagaaaggaatgtgaaaaaatggaaatcaaagaagaaaacaaacgttttgccttatacgatgacggcaaggaaataggagaaatcacctggcaagaggcgccagacgatgtgttggtggttgatcatacatttgttgattctgcgtatcgcggtcagaagttagcacaaaagttactgaatgcggtggtagaaaaagcgcgccgcgaagatcgaaaaatcatgccagtttgttcattcgctgtcaaagagttcaaagaaaaatcagaatatgatgatgtattggctcgctgaatttcggtagaaaatgattgagacaacagtcgtgcaacaacgatctttatgttgctgtacggctagtgtctttttttgttccgggatttagtagttgtcttgtttggatgcagggaacatcgccatagcatcaataaaatatactggaaaaaaggtcccgaatgtggtagagttaaaaagacgattctagcaagcaaggaggagctatcgtgtacaatatattattagcagcagtgattgtgatttctgtgatcatggttattacgattatgatgcaaccaagcaaacaaaatagtgctgccagcgcgtttacgggtggagcagaccaattgttcggtaaacaaaaagcgcgtggatttgaagcggtaatgcaacgttcaactgccattttaggctttgtatggatggtcttgctatttcttttggcctatttgtcatcaaaataattggatgaaatttggaacctctcggctgcgaggggttttttctttgccaaaaatcttatgaacgcatttatcgttgaaatcatcgaactatggtagaattggacgtgaggtgaaacgaagaaatgaagaattttaaccaaccaaaaccagtgtttgctccccacggagatcgggcagtgattttgttccatgcttattctggtagtcccaatgatgtgcggatgctttgccggtttttagaacaaaaagagtatactgtttatacaccgatgttttcgggtcatgggacaacaaaccctgaagatattttgaatcaaggaattcaacaatggcgagcagatgccaaagcagcgattgaatttttgaaagaaaaaggttaccaaaaaattgctgtgttgggattgtcaatgggaggcatctttgccatgaacagtttgacacaagcggaacctgcgctaatcggtggtgggctattctgttcaccgctctttgaaacaaagaatgatgtgccgcgaaattttgaaaaatatgcagaaatgattctgcaatactcttcttattcatccgaagagcagcaaatgattttggctcgcgtaccgcaacaagtcagagatcagctgctagaaattgaatcgattgggcaagaaacagcaactaatcttgacacgatcgatgtgcctgtttttcttgcacaagcaggaagagaccgtatgatcgatccccagacggtttttcgcacagcagcagcattgtctcatgtgccctacacattacagtggtatccacatagtggacatgtagtgactgtcggcccagaacgaaaaaaattagaacaagatgtttgggcttttctggaaagcctcgcttgggaagggtaaaaaatgaaagagacgattaaaacaaaaattattcagttcatggaagaaagccgcaagaaaagcttttccatggaagaaattgccgaagcattgcaactgcaaaaaagcgaggatttcaaaaatcttgttcaaacagtagccgcaatggaacgagaggggagcattctcttcaataagaaaggcaaagtcaaattgccaatgcagcgagtcttagttgaaggaacattccgagcaaacgaacgaggctttggatttgtgagtatcgatgaggaagaagacatctatattcctaaagaatcgactggctatgcgatggatggagatacagttgctatcgacatacttcatgctgctgatcctttttccgataaaggggcagagggcaaagtcgttgaaatccgcaaacgggcagtcacacaagttgtcggtgagtttacactctttgatgaagcggagatccaagaaacagacctctatggagtcgttcagccaaaagataaaaaaatgaatgagttaaaagtattcatcggtgcagaaggcgttcgtccggtagatggcagcattgtgatcgttgagatcactcactatccggagaaaggctactctaaaagcttggaaggactagtcaaaaaagtagttggtcataaaaatgatcctggaatggatattttgtcgatcgtcgtagctaacggcattccgacaaagtttgaagaagcaacattagcggaagctgatgcagttcctgatgccattgatccggcacaattcccagaacgtcgtgacctgcgggaacaattgattgtcacgatcgatggggcagatgcgaaagaccttgatgatgcggtcaccgttcgtaaattagccaacggcaactttttcttaggggtccatatcgcagatgtttcttattatgtgacagaaaacagtgccctagacaaggaagcttttgaacgaggcaccagtgtctatctgaccgatcgggtcattcctatgatccctcagcggctgtcaaatggtatctgctcactgaatcctcacgttccgcggttgacaatgagttgtgagatggaaatcgattcttcaggtaaagtggtcaaacatgagatttttcaaagcatcattcaaacaacagaacgaatgacttatcaagcagtaaatgaaatcttggaagaccaagagcctgagacaatggcgcgttatgcctcgcttgttccgatgtttaaggaaatggctgaattgcatcaaatcttagaagcgatgcgcgttcggcggggggcagtttcttttgaggatcgtgaagccaaagtattggttgacgaagcagggcatcctcaggacatccttcttcgcgaacgaggagttggcgaacgattgattgagtcctttatgctggctgctaatgaaacagtggcagagcatttcaacaaacgtcgattgccgttcatttatcggatccatgaagaaccaaaagaagaaaaaatgcggcgcttttttgattttgcttctgcgttaggaattgttgtcaagcagacaaaaggctccatcacgcccaaagatctacaaaaagtcgtggaagatgttgcagataaacctgaagcgatggtggtcaacaccatgctgttgcgaagtatgcaacaagcaaaatattctgaagataactatgggcattatggactggctgcagactactatacccacttcacatcaccgatccgccgataccccgatttgatcgttcatcggctgattcgttcatacagtacggatccgtcagaaagcaatcaagaaaagtgggagcagaaccttccagatattgctttacacagttcacaaatggagcgaagagcagtggaagcagaacgtgaagtagatgctcttaaaaaagctgaatttatggccgataaagtaggagaagagtttgacgggattattagctcagtagtaaaattcggacttttcgtggagttgccgaataccatcgaagggttaatccatattactgcattgaaacaagattacttccattacttggaaaaccacctcgcattagtaggtgaacgtactgggcaaacgtttaagatcggacaaaaagttcgcatcaaagtgatcaaagcggatccagagactcgcgaaatcgattttgaattgattgaagcagaagaagtcgtacgaatccaacagcctaaaaaaaagcaaaataaagaaaacaaacagcgaagacaaacctcagatcgacagaaaaaagaaaatttacggggaaaatctcctcgtaaaaagaaaaaaaacggaaattcaaaaaagaaacctttctataaaggaattaagaaaaagtaggagggatgaccgttgcctaagggagagggcagactaattgcccaaaacaaaaaagctcgtcatgactacacgatccttgatacgatcgaagcagggatcgtgctgcaagggactgagatcaaatcgatccgcaacagtcggatcaatctaaaagacggctttgttcgtatccgtaatggagaagcctatttgtataatgttcatataagtccctatgaacaggggaacatttttaatcatgatcctttgcgtacaagaaaattgttactgcataaaaagcagattgctcggttgatcggtgaaagtaaaaatacaggaatgaccattgttccgctaaaagtttatatcaaagatggttatgccaaagttttgatcggcttagccaaaggaaaacgcgaatatgacaagcgagaaaccctaaaacgaaaagatcaggaacggcaaattgatcgtgctcttagaaacttttaatcttctaagaagttcttttagaatcatttaaagtgtattgctttgagattagggaaaaatttggtagcatttaaggcaaaggtactgatgtaccaagcttttcatgaaatttcacgacagtgtttcaattaattttttttcgaattttggcagaaaaacttttttgtctaattttcttgaaaatactttgaaattttcttgtcgtggtggtatgataccgattgttatgagaggaaacgcattgtaacaccagatattttctggagatgacaggaaaagaggtgagaaagattggatgaaaaatcgcttatgtttcacatcggtccgatttggtttgatggaactgtagcaatgatgacaatcatttcttgtataattgtttttttggtggtgttcatttgtacacgaaatttgcaaatgaagccaaaagggaagcagaactttattgaatgggtcattgattttgttcgcggaatcgtagctgacaatataccaggatcgcaagtgaacaactttcatttgctgggtgtaacaatgtttctttttgtgtttgtggcgaatgaaattgggctggtcacaaagatcgtgacagctgatgatgtctctttatggaagagtcccacagcggatccttttgtcaccttgacacttgcacttatggttattagtttgacacatttctttggtatcaaaacgcttggtttcaaaaactttatgatcaattcttacttgaaaccagttggtttcttattaccattgaaaattatcgaagaatttacaaatgttattactttgggcttacggctttatgggaatatttttgctggagaggtcttgttagggttgatagcgaatatgttcacaagtctaggttggtggtcattgcctatcgcgatgccgcttgaaatgatttggattggcttctcattgtttataggcgccatccaagcctatgtatttgtcacattgaccatggtatttatgagccacaaaatcgtggcggaacactaatcaaaacaaacacttttaggaggaaaaacaatatgaatttcatcggagcaggattagcaattatcggagcagcaattggtgcaggttatggtaacggacaagtaatcgccaaaacgatcgaatcaatggcacgtcaacctgaaatgtcaggtcaattacgttcaacaatgtttatcggggtagcgctagtcgaagctgtgcctattttgggggtagttatcgcgttgctattagtcttccaaggctaaacgtgaaaaaggcagaaacgaacaatgcactcgtttttgcttttttaaatgagagaattactttcagaaaggaagagtcgttatgctaaatcacttggttctagcagaagtaaaaaatgctatgcttggcaatattattcttgtcagcggctcaattcttcttttgctattcttgttgaaacactttgcatgggatgccattagtagcatgatgcaaaaacgggaagaaaaaatcgccaatgatttggattcagcggaacaatcccgcttgaatgcagcgaaactggaaaaagaacgccaagaaaaattggccaattcccattcagaagctgcggagatcatcaaaagcgccaaagacagcggagaattgagtcgccaaaatattttgaacgagaccaaagaagaagtttctcgtttgaaagaaaaagctcactcagatatcacgcttgaaaaagaagctgcgttaaaagaagtcaaagatgatgttgcagatctttcacttcaaatcgcagaaaaaatcttgggccgtgaattgactcccgaaaatcatgaatctttaattaatcaatatatcgaaggattaggttcagtcaatgaaactcgataaatttactgtaggtaaacgctatggcaaggcgttgttcgaattggcgatggaagaacaacgagctgaagctgtttatcatgagttgatgacactacgtcagatttatcaagagattccgatgtttggccaaatcgtgaccgataatcgtttggatcttcatgaaaaaagaaaacttgttgatcagttatttaataactttgatggattagtcaaaaattttcttgagatcgtgtatgaatataatcgtatggacgacctattgctgatcattgatgagtatgaatgccgctatgacgagcagcaaggtttagtcagtggtacggtgaccacagcagttgcattgtcgtcaagtcaaaaagaacaattgtcgaaacaaatcgcacagacgctcggctaccagaaagcagtgctttcagaaaaagttgatccagccattttaggtggggtcatcgtggaagccaatcatcaagtgatcgacggtagtattaagagccaactggattatctgcgacaacagatcggcagataaacaagagataagaggtgaatcggatggccatcaaagcagaagaaataagtgccttgatcaaagaacaaatcaaaaattatcaaaatgaactttctgtagaagaaattggaacagtcacatacgtaggggatgggatcgcccgggctcacggattagaaaatgcgatgagtggagaattgcttgagttttcaaacggttcttacggtatggcccaaaacttggaatccaacgatgtagggatcatcatcttaggtgaatttgaatccattcgtgaaggtgacaaagtaaaacgtactggaaaaatcatggaagttcctgttggggatgccttgattggacgagtagtgaatccgttaggacaaccaatcgatggcttaggtccaatcgatacagataaatctcgtccggtagaagcagctgcacctggtgttatgcaacgtaaatccgtttcagaaccaatgcagactggattgaaagccattgatgctttagttccaatcggacgcggacaacgtgaattggtcattggtgaccgtaaaacagggaagacaaccatcgcaatcgatacgatcatcaaccaaaaaggtcaaaatatgatctgtatttatgtagcgatcggtcaaaaagattccacggttcgtgcacaagtagaaacattgcgccgttatggtgcgcttgactatacgatcgtggtatcagccggtgcttctcaacctgcaccactattatatatcgccccttatgctggagcagcaatgggtgaagaattcatgtataacggtaaacacgttttgatcgtttttgatgatttatcaaaacaagccgttgcttatcgggaactttccttactacttcgtcgtccgccaggtcgtgaagcttacccaggggacgttttctacttgcattctcgcttattggaacgggctgcaaaattaagtgatgaactaggcggaggctcaatgactgccttgccattcgttgaaacccaagcaggagatatctctgcttatattccaaccaacgtgatctccattacagacggacaaattttcttagaaaatgacctgttttattcaggtgttcgccctgccgtagctgccggactttccgtttcacgggttgggggttctgcacaaatcaaagcgatgaagaaagtggctggaacattgcgtttggacttggcaagttaccgcgagttagaagccttcacgcaatttggttctgatttagatgccgctactcaagcaaaattgaatcgtggacgtcggactgttgaaattttgaaacaaaaactgcatgaaccattagcagttgaaaaacaagtggttattttatacgcattgacgcacggattccttgacagtgtgccagtaaataaagtattagactttgaagcagaattgtttgaatacattgaagcaaatcaagcagatgtgtttgaaacgattcgtgcaacgaaagacttgccagaagaaagcttattagatgacacaatcaaagcattcaaagatattttcatggctgcaaatacatcacgtgtttcagcacaagacaaaatgtcaacaatgcaaaatgcataaaagaggtgagaatgaatggctgcttcattaaatgagatcaagcaacgaattgcctcaaccaagaaaaccagtcagatcacaaacgccatgcaaatggtttcggctgctaaattgactaaatcagaagcacactcaaaacaatttcaagtctatgcaacgaaagtgcgtgagatcgttactcaccttactgcgcaacaactctcagatcttgcagctgctggacctaaagagggcgtcaattacaacagtatgcttgttagtcgtcctgtaaagcgcactggctatatcgtcattacttcagatggcggtttagtcggtggctacaacagttcgattttgaaacaaatgatgacgatgctggacgaagatcatgctcaagatgaagaatatgttatgatcgccatcggtgcgacaggagcagatttctttaaaacacgaggaatcaagttagcttatgagttgagaaatctttccgatcagccaagttttgacgaagtgcgtaaaattgttaccttagctacaacgatgtatcaaaatgaagtatttgatgaactatatgtttgttataaccatcacatcaattcgttgacgagccaatttcgcgtggaaaaaatgctgcctatctcagatttggatccagaagaagcagaaagctatgaacaagagtatttgtttgagccttcaagagaagcaattttggatcagttgttgccgcaatatgctgaaagcttgatttatggtgccattgtcgatgccaaaacagcagagcatgctgctggaatgactgcgatgaagacggcaacagataatgccaaaaatattattggggatttgacgatttcttataaccgggcgcgtcaaggagcaatcacccaagaaattactgaaattgttgcgggggcatccgcgttagaataatttcgagaacgaatggaggaatacgaatgagttcaggcaagattgttcaagtcattggtcccgttgtcgacgtggaattctctctagaccaatccttaccagatatcaacaatgcgttgatcgtttacaaaaaagacgagaaaaaaacaaaagtagtattggaagccgctttagaactaggggatggtgtgatccgcaccatcgcaatggaatctacagacggtttgcaacgaggaatggaagtcatcgatacaggtgcctcaatctctgtccctgtaggaacagatactctaggccgagtatttaatgtactaggcgatactatcgacttggaagcaccattcccagaagatgccaaacgtagtggtatccacaaaaaagccccagatttcgatgaattgtcaacaagtacagaaatccttgaaactgggatcaaagttatcgatttattagctccttacttaaaaggtggtaaagtcggcttgttcggtggtgccggtgttggtaaaaccgtattgattcaagaattgattcacaatatcgctcaagagcatgggggaatttcagtatttaccggtgttggcgagcggacgcgtgaaggtaatgacttgtattatgaaatgaaagaatcaggcgttatcgaaaagacagccatggttttcggtcaaatgaatgaaccaccaggtgcccggatgcgggttgctttgactggtttgaccattgctgagtatttccgtgacgttgaaggtcaagatgtgctcttgtttatcgataatattttccgtttcacacaagcgggttctgaagtatctgccttgttaggccggatgccatcagccgttggttaccaaccaactctagcaactgaaatgggtcaattacaagaacggatcacctcgacaaaaaaaggttccgttacatcgatccaagccatctatgtgccagccgatgactatactgaccctgccccagcaacagcattcgcccatttggatgccacaacaaacttggaacgtaaattgactgagcaagggatttatccagcggtcgatccattggcttcatcatctagtgcattagcacctgaaatcgtaggggaaaaacactatgaagtagcaaccgaggttcagcatgcgttgcaacgttatcgtgagctgcaagatatcattgcgatcttagggatggatgaattgtcagatgaagaaaagactctcgtagcgcgtgcgcgtcgaatccaattcttcttatcacaaaacttccacgtagcggaacaatttacaggacaaccaggttcttatgtgccagttgaagaaaccatcaaaggatttgctgagattttagaaggtaaatacgatgatcttcctgaagaagccttccgaagtgtaggtcgaatcgaagatgtaattgaaaaagcaaaagcactaggttattaataagcaaccatagagaaagaggggaacctcatggatcaatttttaacggttaatgtggtgacacctgctggtttggtgtatgaacaccatgccaaaatcgtggttgcacgaacgacagatggagaaatcgggatcttaccgcaacacgcgccgatcatcgtgcctttggctatcgatgaagttcgagtgaaacggatcgattccgatactcacgtcgattggatcgctgtcaatggcggaatcatggaagtgcgggacaatgtagtttcaattgtagccgatagtgctgaacgtgatcgtgatatcgatgtttctcgtgctgaacgtgccaaacagcgtgccgaaaagcaaatcgaagaagcaaaacaagtggaagatatcgaccaaatacgacgtgcgactgttgctttgcatcgtgcaatcaatcgaatcaatgtgtcaaaacattcctaagcgaagaccagtggtctttgcttttttttatctcaaaaacgttttaaagtctttttaaagtcttccaatgaaagtttcaagaaagaatattttggctcttttaaattttgtggtatgatagtaacgttcagatgtgaaaaggagaatcgaggatgcaagtttatggagtagatgcgattattcgtatcgtcagtcatttagcatttatctatttagcgttttgggcgttgcagtctttgcggatcgatgctttttttaaagccttacaaacgacgcaaatacggatggtcatggtctttttagcaattgctttaggctatactgctagcacttttttccttgaactgattgcattatgccgtaatttatttttaataggtttttaagaaattcaataatacatgcaggttgtgcgattgtatgctataattgtcaagattttgtgtatgattcaactgcattatttggagggaacaaaatggaagagattatcgttcaaggtggtaatcgtttaattggaactgtcaaggttgaaggtgcaaagaatgccgttttacctattttagcagcaagtttgttagcagaagaaggaacaacgactttagagaatgtaccgattttatctgatgttttgacaatgaatgaagtgatccgtcatttaaacgtcgagattgcttttgatcaatcaaaaaataccattacaatggatgcttcccgcgaattagctattgaagcaccgtatgaatatgttagtcaaatgcgtgcatcaatcgttgttatgggacctttattagccagaaatggtcatgcgaaagttgcaatgccaggaggttgtgctattggcaaacgaccaattgatctgcatctcaaaggattccaagctctgggagctgaaattattcaaaaagatggctacatagaagcgattgctagtgagttaaaaggaaatacgatctaccttgattttccgagtgtaggcgctactcaaaacatcatgatggcagcagtcaaagccaaaggaacgacgatcattgagaacgtcgctcgagagcctgaaatcgtagatttagcgaacattttaaataaaatgggcgcaaaagtctttggtgctgggacagaaaccatgcgcattgaaggcgtcgaccatttgcatgcggtctctcatgcgatcgtacaagaccgtattgaagcaggaactttcatggtagctgctgcaatgacagaaggcgatgtgattatcaaagatgcaatttctgaacacaatcgtccactgatttcaaaattaactgaaatgggtgctaaaatcactgaagttccagaagggattcgggtagttggacctaaaacaatcaaagcaactgatgtaaaaacgatgcctcatccaggtttcccaacagatatgcaagcgcaaatgacggcgattcaaatgttggctgatgggactagcatcgtgaatgaaacggtttttgaaaatcgcttccaacatttagaagaaatgcgccgtatgaacggtcatgttaaaattgacggaaacatcgctgtgatcgaaggcggccacgaattacaaggcgcgctagtttatgcaacggatctacgagcggcagcagctttgattttattaggcttgcgttcaaacggattgactcgtgtccgtaatctgaagtatcttgaccgtggctattataaattccacgaaaaattgcaacagttaggtgcttctgttgagcgggtaacaacttctgaaaaaacagcaccagtaaccgtttaaagaggagatgcgaccttgaagcttaatcgatatattttaactagtttggtaaaaattttgttggttatcttattggcgatcctgctctttattgccggcactatgatcggctatggtatcattggagacggtatgccgttaaaagtgttctcgcctcatctatggaaccatatattggacttcatgaagtaaacaaagctgaaactagaatggagcacattgctttattctagtttttttcaattctataaatagaagagagaggagtatgagatgtgagcaagcttttgattggatttgttcggctgtatcagcgattcatctctcccttatttccccctagctgtcgctattatcctacgtgttcgtcctatatgattcaggcgatccaagtacatggggcaggtaaaggaagtttgatgggaatctcgcgaattttacgttgtcatccgtttgtaaaagggggaatcgactacgtacctcagcgctttacactaaaacgaaatacccaagatcaggagcagcctacttatcactatcgcaaaaaataaacccttcaaactgcaggggtaggcaggaatgaacggagtaaaggagcaaaacgatgattcgagctttatcaccaaaagaatctttgccatggccgctattactggatgctgatccagaaaaagaagcggtagatcgatacatacaagccagtgagattcttgtttttgaaaatgagcagcagatcgtaggagtgattgtttatcaactgcaaacagcaggatgggaaatcatgaatgttgctgttgcaccggaagcacagaatcaaggaatcggtggtcgtttactgaccgcagcgttaagtaagattgctgcaacaaaaactacggaaactctttgtgtaactatcaaaactggtaatcttccttccgcagcgttaacactttataaaaaaatgggtttcattgaaaaaaaagtagtcaaaaactattttgtcgatcattacaaagagcccatttatgagaacggcattctacttactgatcaagtgattttagagaaaattctctaaaaagcatctcgcgcactttgacttcatttgaaaaatgggttttgtccgccattcatgttactctgaatcaaatcatttagagcgcgttattgtccttttcaacgaaatcaacagaaatcgctttcttaactgaggaaagtacagtaaaataagggagacaactgagtgagaaaggaatgttgagatgacattactagtatttgatatgggcggttctgcagtgaaatatggattatggcaggacgaacaattaagtgacaaaggacaatttgcgacgcctgatacttggcaaaaaatgaaagaagagctcaaagcaattcgagatagcattaaaaaacctcttgaaggcgttggcattagtgcgccaggagcggtgaatgttgcacagcagcagatcaatgggatcagcgccattccatatattcacggatttaatattttcgctgaattggaagcgttatttcaattgccagtcactattgagaatgatgccaattgtgccggaatggcagaattttatcaaggcgctgggaaagattttgacacggcagcattcatcgtgattggtactggggtcggcggagcactttttcaacaaggaaaactgatcaaaggcgcccatctttacggcggcgagtttggtttgatggttcttgataaaggcaaatctttttcgcagttagggacggctgttcaaatggcttggcgttattgtgaccgaatcggtgtggaccgcaaaacgatcagtggcgaggaagtctttcgtcgagcagaagaaggtgatattatcgccaaagaagaggtagacaaattttatcgctatttgactgaagggttattcagcatccaatttgcttttgaccctgaagtattgattattggtggcggagtcagtgcaaaagcaggattgttgccagaaatcaatcaacgaatgaagaaaatgctggcagcacaagacttaaatgactttgttccactgattaagctttgtgactatcgaaatgatgccaatctagttggagcggcagctaatttcaccgcacaagtgctgaattgattcagctcattgttgctgccattttttcaattttaaacataaaccttgaatcaacagatacacaagttgtgatcactttggaagagtggtcacaactatttttttcggaaatcgattacaatcgcgacgcatcaatctttattttttttaaaataatttaaagtatctgaataaagaaaatattctgataattcgttgacattttccctattattaagtatatttgataacatatccatgggagtaggggaggaataatgatgaaaaagaaatttgcatttttatttgctagtttatttttattatcggcttgtagtgcgggaccaactggtggttccactagcggtagcggttctgctagcggtggcaacaaacaagaaggtgatacgatcaaaattggtgtcaatttagaattatcgggtgctgttgcagcttatggaacggcggaaaaagaaggaattgatctggcggttgaagaaatcaatgagagtggcggtatcttaggaaaacaaattgaaattgtttcaaaagataacaaatctgacaataatgagtcagcgacagtcgcagccaatttaacgaccaatgataaagtagtagcaatgatcgggccagcaacttcaggtgcgacgaaggcggcattgccaaatgtcaccaaagcacaagttccgttagtgacaccttccggaacagatgatgcgattactgtcagcagtgacaaagttcaaggatttgctttccgttcttgtttccaagacagtttccaaggaacgatcttagcaaaatatgctgcagacaacttggatgctaaaaaagcaattattttaggcgataattccagcgactatgcgaatggattatcagcagcctttaaagatagctacaatggcgacattgtactcgaagagaatttcacagaaggtgacaaagatttccaagcggtgttgacgaaaatcaaaaatgctgactttgatgtattgttcattcctggctactacaccgaagctggtttgattatcaagcaagcccgagaattgggaatcgatcagccaattattggtgcggatggctttggtgatgaaaaaatggtccaaacagcaggcgcggaaaatgtatcggatgtttattatacaggacacttctcaactaaagctcctgccaatgacaaggtagaaccttttgtcgaagcattcaaagcaaagtatagcaaagaaccttccgcatttaatgcattggcatacgacgctgtctacatgatcaaacaagccattgaagatcaagattcagcagactcaactgcgattgctgaaggactatctgctttgaaaaacttccaaggtgtgacgggagagatcaccatggacaaaaatcataatccagaaaaatcagcagttgtattaggactaactgaaggtaaagaaacgtcagctgatacagtaaatccttaaatagaaggaccgttctttacacgatcaaatagggactgagacaaagtcgaaggtaagcgaacaaaatgatgaacgataaatgaaaaagtcgtaaatctgtgatcctatcaatcatggcagatactcatttgactcgttgctgcagacttctgtcgcggttcctttttcttagacaagtatcaagaatttaaggtattggaagtgaaaacatggaaatgatgatccaacaactaatcaacggtttatttctaggtagtatctatgccttattagcgttaggctacacgatggtttacggcatcattaaactgatcaactttgctcatggtgaagtgtatatgatcggcagttttattggttattttttgatcaatcaatggaatctgggcttttttcctgcactattcatctcaatgattgctagtgcagcgttaggcgtgacgatcgagtttctggcctatcgcccactccggaattccacccggatctcggctttgatcaccgctatcggtgtttcctatttattgcaaaatgtcatgatttttttcttttcaccagatgtccgaccatttccacaagccattgcccgcaaaacttatagtattggttttgtggaggtaagtaacatacaattattgattttagcagtctcattggcgttaatgatccttttacagctaatcgtcaagaaaaccagaatgggaaaagcgatgcgtgctgttagcgtggatgcggatgccgcacggttgatggggatcaatgtcaatcggacgatttccttcacatttgctcttggttctgcgttggcagctgctggtgggatgttaattggattgtattacaattcgatcgatcctacgatgggggttgtgccgggactaaaatcttttgttgcggctgtattaggcggtatagggatcattcctggggcagcattaggtggcttcgtgatcggactaattgaaacagttgctactgcattaggtttttctgattataaagatgctttagtctatgtcattttaataattatattgttggtccgtccggcaggaatattgggcaagaacctgaaagagaaagtgtaggtgtcagtgatgaaaaagaatttgaaatacaacattacttggttagcactcgccgctgttatctacttcggtttgtttgcagcttataacggcggattgatcaatctattttcagacgcgattatcgtcaatatcggaatcaatattattttagcagtagggctaaatttaattattggtttttcgggacaattttctttaggtcatgcaggttttatggcgattggtgcttacgcaggggcaattttaacagccaacaatcctacatttggcggatttctttctggtcttatcgtggggatgttcgtttcggggctgatcgcactagttgtcgggattccaacattgcgcttgaaaggagactacttagcgattgcaacgttaggtgtttcagagattatccgtatcttattagtcaatttacgaggattgacgaatggacctgcagggatattcgggttaccgcaattcagtaattggcaaatcgtctttctttttgctgtcggctccatcttggtggtctctaattttatccatagtggaccaggacgagcaacattagcgatacgagaagatgagatcgctgcggaagcaatgggggtcaatacaacgaaatacaaagtgattgcttttgtgatgggtgctgtcatggctagtattgccggtacattatatgcaagttatcaacaatcggtatttccgaaagattatggctttatgaaatcgatcgatgtcttgatcatcgttgtgtttggcgggatcggtagtacgacaggagcagtggtttcagcggtcgtattaggtatattgaatatgtacttacaaggcttctcagatttgcgcatgattatttacgcactggcattgatcgccattatgattttcaagccaagtggacttttgggaacttgggaattttctgtgaagcgcatctttgataaatttacaaaaaagggggatgacacgaatgcctctattggaagttaagaagctgactaagaactttggtggtttggcggcagtttcacatgtcgatttacatttagaaactaatgaactagttggcctgattggtccgaatggtgcagggaaaacgacactcttcaatctgctgacaggcgtctatgaaccaagtgaaggcgacgttcttttagaagaacaaggacaatccaagcgattgaatggggagaagccctatcttatcgcagctatgggattatcccgcaccttccaaaacattcggttgttcaaagatcttacagtgatggacaatgttctgattgccatgaacagcaaacaaaaagaaggcttttttacgagtgtgttgcggttgccaaagttttatcacaaagaggctgcaatgaaagagaaagtcatggaattattgcgtatctttgacttagaaaataaaagccaaacactagcaaaaaatcttccttacggtgaacaacgacgtcttgagatcgttcgggcattggctactgaaccaaagatcctttttcttgatgagccagccgccgggatgaaccctcaggaaacagcggaactgactaaattgatctaccgtatccaaaaagactttcaactgacgattttattgatcgaacatgacatgagtttagtcatggaggtttgtgaacgcatctatgtactggaatatgggcaagtgattgctcatggaaagccagaagagatcaaaaatgatccgcgagtgatcgaagcctatttaggaggggaactctaatgctgcgtattgaaaatttaagtgtccattacggcatgatccaagcggttcatgatgtttcctttgaagtcaatcaaggagagatcgtctcgttgatcggtgccaatggtgcagggaaaacgacgattttgcggacgatttccggtctgatccgaccctctaaaggcacgattctctttgaaggcaaacccatccaaaaagaagctccacaaaaaatcgttgctaatggattatcacaagtacctgaaggacgtcacgtttttccaggactctccgttcaagaaaaccttgagatgggcgcttttttgcgaaaagacaatcaagtcaaagaggactatcagcaggtcttcacgaaatttcctgtcctaaaagaacgactaagtcaagatgcttcaacgttatcaggaggagaacagcagatgttggcaatgggacgtgcactgatgtccaagcctcggttgcttttactcgatgaaccatccatgggcctagccccaatattcatcaaagagatcttctcgattatccaagaaatcaaacagcaaggaacgaccgttttattgattgagcagaatgccaaaatggctttgtccattgctgaccgcgggtatgttctagagactggcaaaatcgtcttgcaaggaagcgggcaagagttattggaaagtgatgaagtcaagaaagcctatctaggtggttaatagcttacaacaaggaggatgaaaaatgagtgtacgtgattttatgaccaagaatgtcatcactgttcattcggcaatgccaatatttgatgcgatagacttaatgaaaaaacatgacatccatcgattgccggttgttgatcagcaacggttagttggcctgattacagaaggcacgattgcagaagcaatgccttcaaaagcgacaagtttaagtgtttatgaaatgaattatttattaaacaaaacgactgtagcagatatcatgctgaagaaagtgaccaccatcaaaccggaggcgctgctagaagacgcgattgcagtcatgcgggaagaaaatgtcggtgtgttgcctgttttagcagatgacgaactagtagggatcattacgaataatgatatctttgatgctttcttgaagatcacaggttactatgagggcggtacaagagtagctcttgagattattgatgaccacagcggtgtcttagcggaaatcacgcagttattaacagatcatcaattaagtattttaacgatcgtggtcaaccgaatggctttgaaaacgatcgtagagattcaagttgaatccagacaagtgtcagaaatcgagaaaatttttgccaatgctgggtatacggtattgagtgcggtattgaccaatcaaaaataagcaaaaatcatgcaaacacaatcagtgattgcatgatttttttctggatgaatggttgactagatttgcttttgctttgcggtgttttctggtagaataaacaaggtatctgaaagaggtgagtatgatgtcgaaaaaaaataaagatattgaagtccgtgtggaagaaaccgttaaggtgatccaaggaaaagaatatgaagtccatcaactagtattagggaaaaaagtgattggtgaaattctcgcatccggtccgaaagaattccaaagctttctgggcgaagaagatttaggtgcaagccgaactttggatgcagcaattgaaacgattttgcgccaatggaacttacatgaataatttcttaaaaaaaatgacattttgctcttgcaatttgttatatttttaggtattataactgagtcaggttttttaaaagccgtttggaggagtagcgaagtggctaaacgcgacggactgtaaatccgttccttcgggttcagtggttcgaatccactctcctccaccattggggtatagccaagcggtaaggcaacggactttgactccgtcatgcgttggttcgaatccagctaccccagtcagtgaacaatcaagaaaagtcagcaagcatgtcttgctgacttttcttcgttatttatagcaaaattctaagggttaaaagttgaagattttttttatttacgataggctataggtaaataactcaggagatgagaagatgaaatttaaattgaatctaaaagaaaaagtcaccgaagcagctgagcatgtgtatgatgttgtcaaacgtgaagattatgctattcgtattgcaccaaaaggtatcaaagttacacaattgcgtaaaacaaaagatacgatcaaatggcgttcaaagaatcattgattgcgaaaagacattgagtaaaacagcccaataacaaataaaccggacaagagttgtcacccgtttcacgttttcctgatttctgagaggaagtactgggggaagcaactctggttcggttttttgatttatacgatatactctccttctcgtatgttacccttcgatttcgataccgagaacggttaagtgtccattggcgactaatttaatgaccagtttagctagttggtcaggagtcatttgactatcggcagtaagccaccagtgcagagtaccaacaaaaatcgatgtcatatattcaataacgaaatccagcggtacttcgatggagctttctgtaatttttaattttgaaaaaatatggtcatattgttcatagagaatctccgcgattcgttgccggactaattcgatggctgcgccatccatgatggtcagataaaaaaagcgattgtcctgaatgtgctgatagatttttgtcatcgcaagttcgactcgtttgatcttgattcgatttccctggactaaatcttcaagggacaaaatcgaagtaaaggagtcgattgccatatcaaaaattttttcatataaatcttgtttgtctttataatgagcatagaatgtcgcacgattgatcatggcttcgtcggcaatatcttggacagtcacttgatcgtagcctttatgctctacgagtcggataaaagcctccatgatatgtttattcgtgcgttgaacccgcaaatcaacttttttcatttttgtgaacttcctctcaatttaaacgacatttttaccgttcctgttgcttatcccacacatcacatgaatctgtttgttgaaatctcaatagattgttcttaaaatagacataagtattataacaaacagtttgtaagataatcaacaaagtgttggataaagcggaggcaccctatgaaaaaattaagtgctggtatcgatgtaggatcgacgactgtcaaaatggtggtcttgaatgaaaaaaagcagaccctctttgccaagtatgaacgccactattcggatatcaaaactgccacaaaaaaagttttactggaagctcaggaagtcatcggtaatcaacaggtcgcactagcaatcactggctctggagggatgggactggccgaagttttagcgatccctttcgtgcaagaggtcattgcctgtactaaaacagtcgagacactgattcctgaaacaaatgttgccattgaattagggggagaagatgccaaaatcaccttttttgaaggggcgttggaacaacgaatgaatggtagctgtgcaggtgggacgggtgcgtttatcgatcaaatggcggtattgttgaaaaccgatgctaatggtgtaaatgatttagcgaaaaattatcaaacgatctatcctatcgcttcccgttgcggggtattcgcaaaaacagatgtgcaacctttgatcaatgaaggagcagataaagccgacatcgccgccagtatttttcaagcagtggtcaatcagacgattgcagggttagctgctggtcgtaaaatcaaggggaaagtggcttttttaggtggccccctttatttcatgtctgaactacggcgccgctttgtggagacactgcaaattgctgaagaagacattatttttccagaaaatccccagctgtttgttgcgatcggcgccgctttatatggagaagaaacagctcaactcaatacattattagcccggttatcaaccgatgattcagcgaaattgcaaccgtctcacacattggcgccgctatttgctacggaagaagagctcgcagtttttagacagcgtcatggccaatcttcggtggaagaaaaaaaacttgcttctcatacaggagcagcctttctcggtatcgatgcgggttcaacgacaacgaaagtcgtattgatcgacgaagtgggtaggattctttactctttttatggcaacaatgaagggcagccattggaaaccaccatgcgggtattacaggaaatgtatcagcagatgccaccagctgtgttcatcgggaaagctgcggtcacaggatatggagaacagttgatcaaaaatgcactgaaaattgacattggtgaagttgaaacgatggctcattataaagccgccgaacatttccaaccgggggtcgattttattttagacattggcgggcaggatatgaaggccatgactatcaaagatggtgcactctcttcgatccagctgaatgaagcttgttcctcaggctgcgggtcctttattgaaacctttgcgcgttcgctgaaatacgaagtcaaagaatttgcgttagcagccactactgccaagaatccagtcgatcttggttctcgctgtacggtattcatgaattcaaaagtgaaacaagtccaaaaagaaggtgcatctgtcggggatatttctgcgggtctatcctattctgtgatcaaaaatgccttgtataaagtgatcaaaattcgtcgcccagaagatctaggtgagaaaatcgtctgccaaggaggaactttttataatgaggcggtgttacgagcctttgaaaaaatcagcggcagggaagtcgtgcggccgtcaattgctggcttgatgggggcttatggtgcagcactgatcgcgttagaaaattacgagattggtgaagtcacagccttgctttcaagtgatgaattgagtcaatttactgctgaaaaagaattcactcattgcgggttatgtgaaaataattgtatgctgactgtcactttattctcagatggacgcaaatttattaccggaaatcgctgcgagcggggtgcccgcatcaaaatcaaaaaagaagagcgcaagataaatttagtcgattacaaataccgccgcttgtttaagtatcgcccgcttcgcaaaaaagaagcgtctcgtgggcgtatcggcattcctcgtgtattgaatctatatgaaaactatccgttatggcatactttttttacagaactgggctttcgcgttgaattgtccccacgatcaaacaaagaattgtatgagaaaggtatcgagacgattccaagtgataccgcttgttatccggccaaaatcgctcatggacatattcaagcgttgatcgaccaaggggtcccattgattttttatccaggaattatttttgaaagaccagaaacagcgcaggctgagaatcatttcaactgtcccatcgtacaaagctacccagatgttattcgcaacaatctggatgatatccgtgctggccgtgtggattatcgtaacccgtttctaaatttggcagacgaaacttcaatggtcaaagtgttgtcagaagaatttcaagattttggtatcactgagacagagatcgcgcacgcattgcggcttggttttgaagaattggatcaatttaagctagatgtttgtcagcaaggggaaaaaaccttacggatgctgaccgaaaccaatcagcgaggcatcgtactttctggcagaccctatcatttggatccggagatcaatcatgggatcgcggaagtgattacccaagagggctttcatgtattaacagaagatagcattgcgcatttgggaaatgtcggtcatttacgggtcgttaatcagtgggtttaccattctcgtttatatgccgcagcacgggtcgtcgctaaaagcaagcagttggaattggtccaactaaactcatttggttgtggaatcgacgccgtcacaacagatcaagtagaagagattatggaacaatatggcaaattgtacactgtattgaaaatcgatgaaggggctaatttaggcgccattcggatccgtttacgttctcttaaggcagctgtcaatgaaagggagaaaaaccattttattcctactcaacgttttgaagaaccagccaagatcacatttactaaagaaatgcgtaaacaacatactttgttattacccatgctaagcccaatccatcaaagcgggttagtcgatgtggcactgcaagcttcgggatacaatgtgatctgcttgccggcggatgatcgagaagcagtcaatgtgggcctgcgtttcgtaaataacgatgcttgctatccagccattatttccatcggtcaattgatcgaagcactccaaagtggaaaatatgacttgcaaaacactagcgtattgatgacacaaacgggcgggggatgtcgggcaaccaattatatcccgctgctgcgtaaagcattgaacgaggcggggtttccacaagttcccgtcgtttcggtctccatgggaaatcaaggcgtggagtcaaatcctggctttaagtttacattaccaatgctcaaacgcgtggctgttgcatttttgtatggagatttatttgaacgagttgtttatcgaacgcggccttatgaagccatctctggttctgtagatcggcttcatgaaacgtggcttaaaaaagttgaaaaaaatgtacgcaacggttcttttactttgttcaaccacaacatgaaaaaaatcattgccgattttgatacgattgatctgcaggacatcgtgaaaccaagagtcggtgtggtaggcgagattttagtgaaatactctcctacagcgaataacgatatcgtgagacttttggaagcagaaggggcggaagcggtagtaccagacatggttggttttatgaattattcgctttataatcagatttggcgctatcaaaacctaggaatggccaaaaaaagcaaatggatcgctgaatttgccattggattaatcgaacggatccaaaaaccgatggaccgtgcgttgcgggcttctcagcgatttgaaggattacactcgatttatcaattagcagatgatgctagcaaaatcttatctattggtaatcatacgggtgaagggtggtttttgactggtgaaatgattgatctattgaaatctgatgtgactaatatcgtttgcatgcagccttttggttgtttgccaaatcatgtggtcggtaagggtgtaatcaaagaactgcggcaccaatatcctaaagccaatattgctgcgattgattatgatcctggagtctccatggtcaatcaattgaatcggattcgtttaatgttggcaacggccaataaagctttgcaaagcagcaactaacattcagcgctttaactatccaataagactgtaccaatttgagggaactttttttcttattttgtcttttgtaagaagaacagaatgaaaaaaaggatttttcccttaaattgacagtctttttagttttttcattggttatttaggtatataccagttataatagaaactgaatggaggaatagactatggcagagaacttacccgtatacatacagatacatgatcaaatcaaagcaaacatcgagaatgaaacctacaaaatcggtgaccgtttgccttctgagcgcgaattagcgaaacaattcggtgttagtcgcatgacattgcgccaagctattcagacactagccgatgaagggattttggaaagaaaaatcggatcaggaacttatgtggctcgtcagaaagtacaggagaaaatgagcggaaccacgagttttactgagatcatgcgctcacttggacgggtgccttctagtaaagcagtggcctacttcttgacagccccaagttcgagtgaaatggaaaaattgcaattagaaggacatgagacgattttacggatggaacgcattcgttatgcagatgatgtacctatttgtttcgaagtggcgagtattccagagaaattgatttacaattttagtaaagaagaaatcatctcatctttgtatcatgtgttagaagaaaagggcggtcataagatcggagctgcctcacaaacgatctcagcaatgattgcttcggagcaaatcgctgattacttgcaaatcaaacgcggggatgcaattttaagaatgcggcaaactacctgttttgaaaacggacaaccatttgaatacgtgcgtacacaatacgtagggaatcgttttgaattttatttagaaaaataagacaggaaatagaaaattatattgaccaaaatgaaagacaaaagtgaaagctagtaaacgaggtgaaagagtagcaagaattgtcagaaatgatgcctcaagcagattcatgaggcatcgcttgacagtagctatctgaacaatcattctgcttcaccagcaagtaatgacaacacaaattcgatctgtttctcaggaaatcggtcgttccacatagctgacagggccgtgtgcgatctctagttgtccttgtaacagatctgttagatcggcttctaccgcggacaaggatatttcgggaaccatcagcgttactcggattttatccgtatagtcaatggatgctaagtgaatgttttggtgctctaagtgattttgcagctttcctagctgaggataatcgatggtcaaataaagtgtctggttaagtgtcccttcaacgataccgatttcctttaaggcagcggcaacagtgcttgcataagcgcggatcaaaccgccagcgcctaatttcgtcccaccaaagtaacgggtcacaacagcaaccacattgattaattcattttttttgaggacatctagcatggggacaccagcggtaccgcttggttccccatcgtcgctgcttcgttggatctcattgttctcgccaataacaaaagcactgcaattatgattagccttccaatgctcttttttgagagcgaggatgaatgctttggcttcctcttcggaagtgacacgtttaagggaacaaatgaatcgggatttcttgatttcttgttcactttgtccatcctcacgaatggtgcgataactattcttcataggctcctccttttattttcagtataggtaatgtggagaaaagtttcaatgaaagaaatcagtaaagaataagtgaacggataaaaaaggaggcgttgccattgagtaaacgcaagaaatacgatatcatcactcattacttaaaatctaatggcggttctcaagtcacattgactttcacacaatttgatgaactgttatttccggcgacagggctgccaaagagtgcccgcaagagcattgattggtgggccaatgattatcgacatccggaaaacggtgcctatgcgtggttgaatgcaagatatgaagtggttcacgtgaatttaaagaaggaatatgttgttttcaatcaattggtcaagtccaattggttaatagacagtaagcgttgacaaatttgaaacttgttctatactaggaataggtaatgttatattatttaaaattttagggagtgttcgatatggctaaaaaaacgattatgttagtttgttccgcaggaatgagcaccagcttattagtgacaaaaatgcagaaagctgctgatgcaaaaggtcttgatacagatatttttgctgtttccgcttcagaagcagatcaacatttagaaagcaaagatgtgaacgttttattattaggccctcaagttcgtttcatgaaaggcgattttgaaaaacgtttagcaccaaagggaatcccattggaagttatcaacatggctgactatggtatgatgaatggtgaaaaagtgttggatcaagcattgacattgattggtgaataagcccaatccattttcaacgattacttaagactattgagtagaaccttacaggtttcgaatttctctgttttggcagaaaatgagaacgagtaaggttctttttttgtggatggcgtactttaattgtgtcgaatgtccaaggctttcgaaaaaactagcgaatgtacctgcttttgaaggcttgatcagtcatatataacgagaggagggatacgatggaagaaggcggtcgtcaaattttagtatccgaaagggaacgcaacaactccgaccaactcaaaggtgacattcgtccagccgtcttaatcaaagagggacaaattgaatgtcagcgttgtggcagctgcttcaataaagaggaggtacaactgccaacagggattcactattgccctgcctgcatccattacggacgggcagatacgtctaaagtttttgtgacagtttcggaacaaagcagcgtcagttttccgaaaattcattggcctggtccactaacggtttttcaaaaaagaatctcacaagcgttggtaagaaattatcaacaaaaaaaagcaacgttggtttggtcggtaaccggctctggcaaaacggaaatgatttttgaagtgatacaagcggcaaggctgcaaggacatcgggtagctgtcgtctctccgcgaatcgatgtgtgccgcgaactgttccctcggatccaacaggcatttcccaaagaatcttgtttactgctttacggagattcagaggaagactatcggtatacagacttgcttgtggcgaccattcatcaactgctgcatttttatcgggcatttgatctgataatcgttgacgaagtagatgcttttccttatgaaggggaccagcaactaaggttcgggttaatgaatgcactgaaagcgaccggctgtctgatttatctaagtgccacaccttcagatgcgttactaaaagaaacaacaaattttgcagtggaaaaaatgccgctgcgttttcatcagcgaccgctgatcgttcctcaactgatttggtatgaaggttggcgtaacgtgtatcaaacaaaaagaagactacggcgcttattgtttcatctgcaacgcctatctcaaacaaattttgtcttagttttttgcccaagtattgtttttatggaacggctagaaaaagctgttcgatcattcttaaaagaggagacgataaccagtgtttcagcaaaagaccctgctcgaatagaaaaagtagtcaaggcgcgcaattcaaagtatcagattcttttcacaactaccatcttggaacgaggtgttacctttgaaaatgtttctgtagtggtgatgggagcagatcatcctgttttttctaaatcagcactggtccagattgctggacgagttgatcgaaaaggtccattcaatcatggagaagttctctttttctatgatcaagcaacatcagcgattcgtaaggcgatcttggaaatccaagcgatgaatcgattagcaaaggagtggctggcaagtgaagtgtagctggtgccaacaggagtttgcacgagaactgtggctgcgggagattttatggccattaggaattcctgcttcagagaagtgtccagactgtaggagtaaattgcagtttgttgatttgactagctgctgcaagacatgttgtaatgaaagccaaaattgtcgggattgtcgctattgggggcaacgttatccaaagtttcagctacagcatcgtgctctgatgacatacaatcaaggaatgcaggagtggctccatcaatacaaattaatgggcgattttcgtctgcgagctacctttctcccagagatcaagcaagctttcaaaggattgctctatgatctggtcatcccgatccccctttctcatgaacgctatcagcagcgtggctttaatcaagtgacagcagtattacaagctgccgggattgattaccgatccttactaaagaaaaagatccatttacctcctcaagcagcaatgactagaaacgaacgattagcagctccacaaccatttattatcgaaaagggtcaagaaatcaaagacaaacgtgtgttgctggtggatgatgtgtatacgactggacaaacaatttatcatgctgcagaagtacttttgacttgccagccgaaaacgatcacgtccttttcttttgccagataaggaattgtaaacgcttaaaaaaatcttagcgattcgctttccaaatgcaagatacttcgatataatagagttaagaagaagaagagagtggtccttttccttcttagtgtggtagacgaaaggggtaatttttatgtttagatataatgtacgtggcgaaaatatcgaggtaactgaagcgatccgcgattacgttgagaaaaaagtaggtaaactagagcgttattttaatgatgtgcctgaagcaacagcgcatgttaatttgaaagtatataccgaaaaaacagcaaaagttgaagtaaccattccgttaccattcctagtcttgcgtgcggaagaaacttctcctgatctatatgcaagtattgatttggttgttgataaattagaacgccaaatccgtaaattcaaaacgaaaatcaaccgtaaatctcgggaaacagctttagtggctccagacaatggcgacttattcacaacggatacaaacgaagaagaaaccaatggagcagaactagacattgtacgtacaaaacgtctttctctaaaaccgatggatagtgaagaagccgttttgcaaatgaatatgctaggacataacttcttcatttttgaagatgccgaaacaaacggcacaagcattgtttatcgccgtaaagacggcaagtatggattgatcgaaaccgattgatcaaagaatgacttgtcgaaaatccccaaaaaagtcttttttgacagagcagagtgatctgctctgtttttttgaataaaaaagctgtgataaaaggggcagttaaacaaaatgattcgctgagtgaaataaaattgccctatcaatcctgcaggtgtaaatccgatctgcgggatcataggggcaatttcatggcctttcggctgctgtgtttgctaaagtctttttgacatagttctttgctgagaaatcaataaatcgttggtactaaaccaccgtcgagtctcaaggcggctccagagaaagaggatgcgtaaggactagcaacgaaagctacaaagcgtccaatctcttctggacgaatgagccgttgaatttgagacagtgggcgatgctttttcatgaaatcttcttcccacatggactccggcaaatcactttcttgatacatcgttttcagcatcgtttctacgccttcggtcagtgttgaaccaggcatgatcgtatttacagtgacctgtgtcccagcggtgagttttgacaaacttttagccaaagagaggttcatcgtttttgtcatgctgtactgcggcatttctccagaaggcataacggcttcctcgctggcaataaaaatcacacggccgaagttttgttggagcatatgaggcaaataaaattttgctaaagcatttcccgacaaaacattcacatggaaaacatgttcccaaacttcatcggtaatttccatgtaatccattggttcgaagatccccatattattgacaagaatatctactttagggaagtggtcaaaaagctgttggcgagctgctgcatcggctagatcatatggagccacttgaggattcgtcttaggaaatttttcttttaattcagcaacgaaagctctgacactgtccttttgccgtccattgacgatgacatccgcgccttcttttgccagctcgaaagcaattgctttcccaatacctttcgtagagccagtgaccagtgctgttttctttgttaatcctaattccatttccttcactccatttccttagttaaagttaaattgatccggatcgggacctacccggtgatcttcattcaaacgattaagttcacgcatatcttcttccgacaaagaaaaatcaaagagttgctgattttgttccattctgtcgggattaactgtcttaactaccagtaaaatatcttgctggatatgccagcgtaaggcgatttgtgcaggggatacgtgatggcgttgagccatctttacgaggattggatgttggagaatctgaccttgcatcaatggagaccaagcttggatcttgattccttgttgctgacaataatcacgcagttctttttgagctaattttggatgtagttccacttgatttaacacaggtttgacttttgctgtagcgagcaatttcttcaaatgatggctctgaaaattgctgacgccgatggctttgatctttccagcttgatggaggtcttcaagtgcccgccaagattcttgatacgcatttttgccaggccagtggagcaaataaaggtctaaataatccaattgcaaaagcgcgagggacttttcaaaagccgcgatcgtttcatcgtagctcaaataattgttccaaactttagaagtgacaaagagttcttctcgtgtaagtcccgttgctgctagtccttctttgatcccttggcctgttccgctttcattatcatatatttgcgcggcatcaatcaaacgataaccttttaaaatgccgttttttacaacagtagctacttcttcatcaggaatttgaaagacgcccaaaccaaagccaggaatgctgacttgttcgttcaatgtaattgtgtcggttaatgaatgaatcatataaatttcctccttgatttttggtaaatataccttatactaaaaaagttcagatgaatagtacctacttttttgtgctatagtgtcaaaaaagtaacttttttgaatttaaaggaagtgtttaaagtatgactccaaaaaaatacaacattggtgtggaagctactatggatgtgatcggtggaaaatggaaaccgattattctgtgtaatctgcgagatggcgccttgcgtccgagtgatttgaagcgacggatacctgatatcagtcaaaaaatgctgacgcagcaactaagagagctggagacagacggcatcgttttgcgaacctcttatcaccaagttccaccaaaggttgtctattctctcagcgactatggtctgacattaagcagcgtattggatgctctctgtcattggggagaaatgcatgtttcaacattgaaagaacaaggcgttgaagtagcgttagctagtcaagaggcgtagggaagatcaaaaacaaaaactagcaatcgtcgagtcgagagtcactcagcgattgctagttttgcttaaaaaaagtgaggtaggaagagggttatttcactgaaccggaagtaattccttgtacataatatttttgcatatagataaagagtagagtgattggaatagcgatcagcacacagccagctgtaaaggacataaacaacgaattggctgttgtttttgtcatcatagaataaagtccgatcgcaacggtatagtttttgacgtcatcacccatgatgattcgagcaaagatgaaatccatccaaggacccatgaaggccatcaaagaggtatagacgataattggttttgataacggcaatgtgatcttggtaaaaatatgccatttattggcaccatcgatcatggcagactcatctagcgccattggaatcgtatcaaagaaccctttggcaacgtagaatcccagtgccgctccagccgaataaaccaagatcagcgctaataagctttgtgttaggttgagggcttttagaatataataaacggcgatcatgctcataaagcctgggaacatattcaataccaaggcaactttcaagaaaggtttacgaagtctaaagcgcaaccgagagagagagtaggccattgcgattgtaataaatgtggacaaaagacagctgcagacagcaacaaacaatgtattcaagaaccagcggacaaaagggtagctgccgctatcattggctaatagttgtcggtaattttcaaaagtgaattctttgggaatgatataaggaacgaaggccccaccttctcctctaaaacttgtcaaaatgatccaaacgatcgggaataaccaaagaacagaaagaatgatcaaaatcgtataaatcagaaaacgggtttttgactgcccttgttggtagccggatttctttttctttacagacattgttacccctccttataagaatttgttcgcgtgtacgcaaacaggctaaagacagcagataagataaagatcaagataccgattacggaagctaaattgtaatccatcgtgttgactgtcaagttgtacagccacgttactaacagatcggtcgagccagcaccatagaaattagagttagatgggccgccgccagtcaataagaaaataacattaaagttgttgatgttgccgataaactgttgaatcaatgcgggcatcattacaaacaatatctgaggaaatgtgatggagcggaaaatttggaatttattggcgccatcgatttcggctgcttctagttgttcctgatcaagattttgtaagattcctgttgttacaagcatggttgctggaatcccgatccacatgttcacaaagataatgctgactttcgcaaagaaaggatcggtcagaaacgggatcgaagaagagatccatccccaattcagtaagagtgagttaatcggaccagaaccgtttagtaagttacgcatgatcaaaagtgacacgaattgaggaactgccatcgtcaaaacaaaaatggtgcgccacaattttttgtaacggatccctttcgcgttgatcaacaaggctaagatcacgccgaagaagaaacaagtgatcgttgcgagtacagcccatgtcaatgtccaagctagtactgggaaaaaggtggacgccatatcaccagtgatgacattagagaaattcttcaatcctacccaagtaaacagattttttgggggtaaatttttgtgatcataattggtgaaggcaatcgaaatcatatataagagcggtaagatagtaaaaaataagacaccaatcaatgggattgtcatcaatgttgcatgaaagcgttcgttcaccagactatgtaaatcgtcgcgtgtcgtagggattttaagtccttgttgttttaattcgtacaaatgacgggcgcttttcaaattaatgatatagagaataatcaagagtgcacaaacgagcagggaagcaataccgaaaagcaataagagcattgaattgtcacctttttgcaagatttcaataccaagtgcttcgttatagaccaacccttgtttttgtgttcctaatgtttgcagcatcagaagagcgtggaaaccatttcttatgaaccaagcgataaaaccaacttgtgatacgatgaaaataattcctttcagccattgtttattggcgaaattagcgcttcccatcaaaataaaagatagttttgtcgctagatcgccttttttgaataattctctaaaagtgatatgcgacgcatgttttttcctgaacatatcctctcaccttgctttcgtaattaactagaaaagggaaagcaggctttccctttgtcatgtatagtgatgtgttgttgattattcggttacttttgaaatatcggaaacaaacttatcgagtttatcttggaactgatctggtttgatttgacctttataggtatcgttgattaacgcatccattggtggccagaaagaaaccatctcaggcaatttaggcattacgacagagtgttctgcatcagacatttccatcacagcttttgctactgcatcagcttttactgcatcagattcttgtgcatctttatttgaagggacaacgccgttttcagtaaattcgatttcttgtgtttcttggttgcttaaatattctgctaaagccatagctgctaatggcgcttcggtttgttggttgacagcataaagttttacacctaagaaagctttcatttgtttcgcaccactgccgaagtcgatcgttggataggcggcaacacccatgttgtctccaagcgctttttctacgtcattttttgaccaaggacctgaaaggaaggcatctgatttaccagattgcaaatcagacaacgcggattcactggcttgaaggacaccgctattatttttttgatcggcgatccattgtaagacttcaacaccagcttcgttgttgaaattggttccattaatatcttcaccgtcttctccataaagaacatttccgttgctcataaatagagggccaaaaatgtagtttgcaccgtcttctgcaaagttggtaccgatttttccagcggaagtcaatccttcccaagtttttacatcatctgctgtcaatgtagaagtattgtaataaagcacttgagattcaacaccgtaaggatagccgtaaattttgtctttccaagtcacggcatcaactgctgcttccacgttcgtatctttgattgttgctgcttgcttatcaccgattggataaatcagaccagcttcagccatttgtcctacttggtcatgaggcatcatgaatacatcggctgcttgttcagggtcctttgagacgtctgctttggcatcggcagaagagccaactgcaactgttacttttacatcaggatactctttttcaaatttgtcgacttgcccttgtaaggcatcaatatgttcggtatctacccataatttaatatcaccttcgacttttgcactagactccgctgcactgccattgcttgaagcagcatcgtcgttgctgttgccacaagcgcctagtacgattgcagacaagcttaaaatacttcccccaataagtaatcgttttacatctaccttcattcttgttcctcctaaaaattaattgtttgcgtttacagacctaattatgcaatcgattgcaataatagtcaagcagaaaatgaacaacttttttggttttctattgcttataagaaaaattaagaatcagtccaacacaaaacctttctacaattggaatgataaagtcgaaattttcaggaaataacttagttattctattcacatttgaaaagcgaatgaaaatgtggcagatcatttttccgtccgttgtaaagcaaacgattgctttctgtttcagagattgttttaaggagcaagagaagtagagtttcttttggacacaagaagcaatgggcgtaaaagaaatctatttaaaacaattgaaaaaagaaaaaaagagttaaaaaaatcatggagaaacatgaactgcgccgaaaaatatttcctttatgatgaactagtgataaaatagttaggagagtttccagttaggaaaagtagaaataaaaggagaattatataggcatggccaatttttttagaaaattaatcgagaatgataaaaaagaattaaaacgtcttgaccatattgcttcacaagttgaatctcatgcggacgaaatggccgctttatctgacgaacaattgcgcgaaaaaacagatgaatttcgcggtcgttttcaacaaggtgaaacgttagaccaattattgccagaagcctttgctgtggttcgcgaagcggcaaaacgcgtcttagggctgtatccttaccatgtccaattaatgggggggatcgtgcttcatgacggaaatatccctgaaatgcgtaccggtgaaggaaaaaccttgactgcgacattgccggtttatttgaatgcgttaagtggtgccggtgtacacgttgtaacggtcaatgaatacttggcaacccgtgactctacagaaatgggtgagttatataatttcttaggattgactgttgggttaaacatcaattcgaagacagcagaagaaaaacgggctgcatatgcctgtgatatcacctacagtacgaataatgaactaggctttgactatttacgcgacaatatggtggtttaccgccatcaaatggttcaacggccattgaattatgccatcgtcgatgaagttgactcaatcttgatcgatgaagccagaacaccattgattatttctggacaagcagaaaaatcgactgcactatacaatcgggtcgataattttgtgaaacgattaaaagaagaagaagattacaaaatcgacatccaatcaaaaacaattggattgactgaaaaagggatcgagaaagccgaagaaacatttggcttggaaaacttgtatgatatcgaaaatacagcgttgacccatcatatggaccaagcgttgcgggcgaattatatcatgatccgcgatatcgactatgtcgtacaagaaggcaaagtcttgatcgtcgaccagtttactggacggatcatggatggacgtcgttattctgacggattgcaccaagcaatcgaagcaaaagaaaatgttgagatcgaagatgaaaccaaaacgatggctacaatcactttccagaactatttccggatgtacaaaaaactttctggtatgactggtaccgcaaaaacagaagaagaagagtttcgtgaaatctacaatatgcaagtcattcagattccgaccaatcgaccaatcgttcgtgatgaccgtgcagatttactttatccaacgctggaaagtaagttccacgcagtggtgcaagatatcaaagaacggcatcgtaaagggcaaccagttcttgttggtacagtagctgtagaaacttccgagctgctttcaagcatgttggatagagagaaagtccctcatgaagtactgaatgccaaaaatcactttaaagaagctgaaatcattctgaacgcaggacaaaaaggtgctgtaacgatcgcaacgaacatggctggtcggggaacagatatcaaattaggcttaggtgttgctgaattaggcggattagcggtcatcggtacggaacgtcatgaatctcgccggattgataaccaattacgaggacgttctgggcgtcaaggagacccaggggtttctcaattctatctttctttggaagatgatttgatgaaacggtttggttctgagcggatcaaagtgttcttggatcggatgaagattgatgaagaagatgccgtgattcaaagtaagatgttgtctaaacaagtagaatctgcgcaaaaacgagtagaaggtaacaactacgatacccggaaaaacgttttgcaatacgatgatgttatgcgtgagcaacgggaagtcatctatggtcaacgtcaagaagtcatcatggaagagcaggatctttcacaaacattgatgaatatggtcaaacgatcgattgaacgagttgtcgatagccatacccaattagaagaaagcaattggaattatgaagggatcgtcgactttgccggaaatgctttagtgcatgaagattccatctctgttgatgatatcaaaggcaaaaaaccacaagaaatcaaagactatctctatcaacgggcagaagaagttttcgagcagaaaaaagcccaattaaacagtcaagaacaattgttagaatttgaaaaagtagttattctgcgagtggtggatacgaaatggacggaccatatcgatgcgatggaccaattaagacagtcagtcggtctgcgggcatatgggcagaacaatccattggttgaataccaaactgaaggatacaacatgtttgaagatatggtgggagcgatcgaatatgaagtgacacgcttgtttatgaaagccgagattcgccaaaatgtacaacgagaacaagtcgctcaaggagaagctcaagaaactgaaacagtcccagaagaagatcctagtttcaaaaatgttggccgtaatgatccgtgtccttgcggcagtggcaaaaaattcaaaaactgtcacggcaaaaaatagaagaattgatacgttaggaaaaaggctggcagcttttcttgtccagccttttccgttcatttacaatacgcgtgaagaaagaaggaaatcaaatggaaatcgcagatatccggaatcaattgaatcaaatgaatgaaaaaataaatagttttagggggtctctttgacttagatcagttagaagaggcaatcgctgaagcagaacaccagatggcggaccctacgttttgggatgattctgagcaagcacagaaggtgatcaacgagaacaatgccaataaagaaacctatgatcagttcaatcaattggcagaagaatttgaagagttggaagttcttttggaaatgatccaagaagaaccagatgcagaaatggaagcagaactagcagaacgtatccaagctttgaatgaaaaaatgggaacttatgaactgtctatgctgttagatgaaccatatgatcgaaacaatgcaatcatcgaactgcatccaggtgctggcggcaccgagtcccaagattggggcagtatgttgttgcggatgtatactcgtttttgcgagcaacatggatatcaagtcgaaacattggactatcaggcaggagacgaagccggaattaagagtgtcactttgttgatcaaaggccataatgcttatgggtatttgaaatcagaaaaaggcgtccatcgcttagttcggatttcaccatttgattcagccaaaagacggcatacctctttttgttcggtagatgtcatgccagagctagatggtgcgattgatatcgaaattaatagtgatgacttgaaaatcgatacttatcgagcgagcggtgcgggcggtcagcacatcaataagacggagtctgctgtacgaatcacgcacattccaactggtaccgtagtggctagtcaagcacaacgttcgcagttgaaaaaccgggaacaagcaatgggaatgttgaaagcaaaactttatcaactagaagtagaaaagaaagaacaggaagctgcagcgcttcgcggagaacagatggagatcggttggggttcacaaattcgttcctatgtctttcatccgtattccatggtcaaagatcaccggactaactttgaaacaggaaatgtacaagcagtaatggatggtgatttagacggctttatcgatgcctacctcaagttgaaattaaatcaaaaataactatactgggctattaaacagattgaaatataattgtaatctgttgaaagcattgtgaaatatattcatgctataataagccagtatgaaaaaaagtgagatggagagatagctgcatgattgaaatgaaagaagtaatgaaaaagtactctaatggtacgactgctatccgtaatctttcgatttcaattgatcaaggtgagtttgtttatgtcgtcggaccttccggtgcagggaaatcgacctttatcaaattgatgtatcgtgaagaaaaagcaacgaagggtgttcttaatgtagcagggtatgacctgttgacgatcaagaatcgcgaagtgccattgatgcgccgcgaaatcggtgttgttttccaagattataaattgcttccgcgaaaaacggtttatgagaatgtcgcttatgcgatgcaagttattggccgcaagcctcgggaggtcaaaaaacgggtaatggaagtattggaccttgtaggattgaaacacaaagtacgagtcttcccaagtgagctttcaggcggagaacaacaacgggtttctattgcacgagcaatcgtgaataccccgaaagtattgattgcagatgaaccaacaggaaatttagatcctgagaattcttgggagatcatgaagttgttggatcggatcaatgcacaaggaacaacagtagtgatggcgacacacaatagcacgatcgtcaatacgattcgtcaccgtgtaatcgcaattgaaaatggtcggatcattcgcgaccaagcggaaggagaatatggttacgatgattagaacgtttttccgtcatctccttgagagtattaaaagtttaaaacgaaacggctggatgacgatcgcgtcactcagtgcagtcacgatcacgttgacgttagtcggtatctttttgggtgttattttaaatgcaacgaagttagccgaagacatccgtaagaatgtggatgtttctgtctttgtggatatcggaacagaacaaaaagacatggatactttggaacaatcgcttaaagaattaccgaatgtttcagacgttcgtttttcgagtcgtgatgatgaattgaaaaaaattcaggatgcgatgggggattcttggaacttattcgaaggggacagcaatccgctttataacgtatacgttgttagtgccacagatcctgaatacacgaaaaaaattgcaaaacaagctggagaattgccaaatgttttcaaagcagactatggtggcgattcttctgacaagatctttgctctatcagctgcggttcgtacttggggacttggggctgctatcctattgatctttgtggcaatgttcttgatttcaaatacgattcggatcacgatcttgtctcgtcaaagagagattcaaattatgcgtctggtaggtgctaaaaatggttacattcgctggcctttcttcttagaaggcggctggatcggattgctgggatcaattgtccctatcgctattatgtattttggttatcaccaagtttacttgttagtcaatccagcactgctacgttccaattatagtttgattgcaccaaatcagtttctactgcaagtttgtggtgtcatggctctgatcggaatcgtgattggttcattaggatcgatcatctcaatgcgccgtttcttaaaagcgtagaacgtgttattgaaacagatctgctgactagcaggtctgtttttcatttgccgacacctttactttagactgcaagttcgctattcttttaggagaggtgagggttggtatgttagttatggataacctgttcacgatcattttcttcgtgaacattttgttgtcgattgtgattatttttagagaaagacggcaaacggctcagacatgggcgtggttgcttgttttattgtttataccagtcgtgggatttgtactctattttttctttggtcgcggaatctccaaagaaaaaattttcgatttgaggacacaagccaaaattggtttgaacgtggagctggaagagcaaaagcaagcgctgcagcggaatctttatccccatccgcccactgcgcaagtagaagtcaaacagctcgtttatttattgacgatctatggtcagtcgttatataccactacaaatgaaatgactctttataaagatggtcgaaaaaaatttgatgcattactcaaagatattgaaggcgccacagatcatatccatatgcaatattatatttatcgcagtgatacattggggggagaagtacgagatgctttgatccgtgcagccaaacgaggagtgaaagtccgtgtgcttttggatgcttggggcagcacccaggtttcactgaaattcttcgatgaattacgggttcatggcggtcaagttgcgttctttttcccgttgttcgttccttatctcaatcctcggatcaattatcgcaatcatcggaaaattgtcgtgatcgacggcaagattggttataccggtggtttcaatgttggaaatgaatatttaggtgaggtggaaaaatttggttattggcgggataatcatctgcgaattttaggaccagctgtttactcactacaaaaccggtttttgatggactggaattcacaacatgctatcgaaatcaaatatgaagcagcgttgtttccaatgatcgaaacaaacggaacgattgctgcacaggtagtgactagcggtcctgattcagaacacgaagagataaagataacttatttgaagatgattaatttagccaaaaaagaaattttgattcaaactccctattatattcctgatgaatcgatccacaatgccttgaaactggcacttttgtccggtgtttctgttcatttgcagatccctaataaaccagatcatccacttgtctattgggcaacttactcttttgctgctgagttattagcctatggtgcagtggtagagacttatgagaaaggttttatgcacgccaaaacgatgattgttgacagtggggtcgtttcgattggttctgcgaatattgatgttcgttcgtttcgacttgactttgaggtcaatacagttgtctatgatgcaaaagttgctgaggaagtgcgccaagcattttttgctgactccaaggattcagaggaattgactttggaaaaataccggaatcgccgattgttgatcaaggtcaaagagggattagcacgacttgtttcgccgcttctatagaaactatttagtaaacgtaggtgaaagttgggtaacaaaaaaacagcagtaatgctgaagcacctcttctaacgtttgttttttggatcaacgttagaaggtgattcatgcaactgctgttttttattatttcatgatacttgtgtaggctgccagaaaaactgacccgactgtcaaaataagcattgtccaaataactacttgagtgattttggcgaaggtgctttttggttttttttcgttcatcgtgatccaccttttagattgatttctagtcacagtttacctccaattaccaaagaactcaagctgctattcttataaattaagaaatcttgaatattttgcaagagcacaaaaagttttttcaaagattctcttgttgaagggtggttgttctgttttaattagtaaagatatagagaaaaaataagtagaaaataagcaggatgcttgagtaaggaaagtaaaagattgcagactgtcttattggaccgcggatttttaaacgaactgaaacatagatgtaaagaaaataaagtatagttacactagctgttagaaaggatttgtttgtatgtctggatttgggcctgctgttttattttggtatatctttccattagtcgttttttttgcttgcagatttttagtttctgcgttgtctttgaaagaacggtttggactgaaggcacccgacttagctgtgccttttttggtgattgggattcatcagttatcaaagaatacttttgagcaatcgatcactccctattatttgatctctatcttattactggggattctcttagctgtctttcaagcgtattattacgaagaaatccagtatggcagatacatcaaaatgtactggcggagtatctttttgtttacattgattttccatgttgttttgatcattttaaatatcgtcacgtatttgtaatttgtgacagggagaacccttatcccatcgagatttttctgcttaaagtttttttaaaaactttttaagagaaagaaactcctgttttttcgtttggtaaaaattagtcaaagaacttcacttttaaatttcacgttaaatgtggtagaaagtgggggattgtggtagactgtgattatcaggtggagatcgggggttatttatcgatgtttatgggtgaatttcaacattcgatagatgcaaaaggccgactaatcgttccttcaaaactgcgagaaaaactcggagaaaaatttgttgtgacacgtggattagatggctgtttatttggctaccccttatctgaatgggaaaaactagaagaaaaactgaacgaaatgcccttggcgaagaaagatgctcggacattcgtacgtttcttttattccgctgccacggagtgcgagatcgacaaacaaggtcgtatcaatattccggcaaccttgcgtgaacacgcgtcacttataaaaagctgcgtgatcatcggcgtttccaaccggattgagatctgggatgaagcgcgttggcaagcatttaccactgaagcagaagaaaattttgatgaaattgctgaaacaatgattgattttggcttataggaagaggaaagcgcatggcagaatttcaacactacaccgtaatgttgaaggagacagtggacggtttagctattcgtccggatggaatctatgtcgattgtacattaggtggagcgggtcatagtgaatatttattgtcccaattatcagaagagggacacctctacgcatttgaccaagatcaaaaagcgatcgatcatgccaaagaacgcttagcgtcttatgtggctaaaggaatggtcacgtttataaaaagcaatttccgctatttaaaggaagctttgcagcaacagggtgtcgatcaagtaagtggtgtgttgtatgatttaggcgtttcttcgccgcaattagatgaagcggaacgtgggttcagttatcatcaggatgcaccattagatatgcggatggatcagtcggctgctttgactgcttatgaggtagtgaatcaatttgattatcaccaacttgtaaaaatttttttccgttatggagaagaaaaattttcaaaacaaattgctcgtgaaattgaacggacacgagcaaataaaccaatcgaaacgactggagaattagtcgagattatcaaaacagcgattcccgctccggcgcggcgcaaaggcggacacccggccaaacggatcttccaagccattcggattgctgtgaatgatgaattaggtgtcattgaagaatctttggaacaggccatcgatttattggaaaaaaatggacgaatcagtgttatcactttccattctttagaagatcgaatcgtcaagtctacgttcaaagcttacagcaccccaaaagatgtgccaccagggttgccgatcatccccgaagaatttcaaccagtactaaaattaattactcgaaaaccacttcttccctctgaagaagaagtatctgaaaacaatcgttcccgtagtgctaaactgcggatcgcggaaaaaatgaaggaaagcgaaggttagcaattatggcagaactaaaagttcatgattatgaatttgaagaaacgtctgaacaagagttttatgctcactctgaaccgacaattgaacagctgccaagcgaacctgagcgtcctgaggttatccgtgtaccagcatctcctgctcgccggttaaaaagtatctctaatttagaaaaactgattgcagcatttgtgatcattgccgttttgacattagcgatcctgacgatcaatattcggactacgatcagtcaagtcgaacatgatatttcactgatccaatcagacatcaatgaaaaaaatagtcaagcagaacaattagagcaagaaagaaacgaactttctaaaactgagcgtatcaaaaaggttgctgaggataatggattgtcgatcgatgatgacaatttaaggaaagtggattaaatgaagctaacagataaattcaagcaatacttgaaaaagaaaaaccaaactacaacgaacaatcgcaaaaaagtaggtattattctctttgctacgagtattggattgttctttttgtttgtcacgcgtttgagctacattgttatcgtaggtaatgtggcaggtacttcattggctgagaaaaccaagagcctttatcaaggaagcgaagttgtcaaagcaaaacgcgggacaatctatgatcgcaacgggatcgcaatcgcagaagatgcaacttcttattctgtttatgctattttgtcaaaatcctacgttagtgggaaaaagaatttatatgctgaagagaagaactttgataaattagccaaaattctgaatgagcaactaggtattgatcagaatgaggctgtgcaaactttggaaaaaggtctaaaagaagaacgttggcaagtggaattcggtagccaaggaagtaaaatgacgctggagaaaaagacagcgatcgaagaagcaatgaaaaaagaaggaatcgctggcctttattttacagatcatccttctagaatgtatcctaatggaattttctcttctcactttatcggctatgctctagcagaaaatgaggagaacgactcttctggcttagtaggaaaaactggtttagaagctgcttatgatgatgtattatccggaacagacgggaaaatcgtctatcaaaaggataacaatcaaaacccgctaccgggaacggtggcagaatcagtggcagcggtagatggcaaagatatctatacaacgattgatagccggattcaaagctatttagaaacgctcatggataaagtgttcaaagaatacaagccagaagatctgactgccacattaatgaatgcaaaaacaggagaaatcgaggcgatggcacaaaggccaacctatgatcctgatgatttaagtaccatcaaaacctggcagaatttattggtcgaagacaactatgaaccaggatcgaccatgaaagtcttaaccacagctgctgctatcgatcaagggatattcgatgaaaatgaaacttttacaccaagtccggacggattgaaactgtatgatgcgacaatcaatgactgggactttggtcaaaaaggaacattgacgatgcgtcaagctctttcttggtcaagtaatattgggatggttactttggaacaacgaatgacagaccgttggcaacaatacttgcaacagtttggatttggtcgcagtacgtactcgggtctgccaaatgagaatactgggatcatgccggaaaataatccggtcagtcaagcaatgacttcatttggtcaagcaatcggtgtgacgaattttcaaatgatgcaggcttttaccgcagtcgcaaataacggcacgatggtcaagccgcaatacatcagcaaaatcgtggacaatgaaacaggtgaagagactgtaacacagccagaagttgttggacaccctatcacggaacaagcagcgacgaaagttcgagaatatatgcgtgatgtggtagaaagtgaaaactacggaagtgcgtatggtgtctatagtgtacctggttacaatatttcagcaaaaactgggactgcccaagtagctgatccaaaaactgggaaatacttatctggggattccaattacttgtactcaatcgtagaaatggttccttcagaagaccctgaatacattctttatctaacaattaaattaccagaacaccacgacagcgaagcattggcaaaaatcgccaatccgttgatgaaacgcgtgatggatttaaagaaagcaacattagaagaaacagcaacagaaaatagtcagaaagtaaccgtcaatgattatcgtaaattagatacaactaccgcggcaactgatgtacaaaaaattggtctagcacctgtagtattaggggatggaaaaacagttatcgatcagtctgtggacagtggatcgaaagtactgccaggagaaagacttcttttgctaacggatagtgacaaaatttatatgcctgacaccaccacatggtcaaaagctgatttagtcaaattgggcaacatgttggatgttgatgtcaaatttgagggcgacgggtattgtgtttcccaaagtcttgcatcttatgaggaaatcacggatcaaacaattaccttcaaattgagcgaaaaagaatagggagagaacactatggaatggacagagatgatattgccacttgccagtagttttgcaatcgttactgctgcaatgccgctgtttatcggctattttcaaatgaaaaaatacggacaagagattcgaggagaagggccaaaatggcacaatgtcaaagctggcactcctacaatgggcggcttcgtatttttgattgcggcattgatcacagcagtttgggttggcgcatggcaaaagcagttgaccgcatcgctgttcattttgttatttattatcttggtttatggtgcgcttggattcttggacgatttcatcaaaattttcaagaaacgcaacatgggtttaaactctttacaaaaattgatcggacaaatcatcggtgggattgtcttttatctggtctttttatcagaaggcaatgcgaatgttttgaatctctttggatttgagctgccgctatcgatcttttacggcgcatttgtgattttttggttagttggcttttcaaacgccgtcaacttaacagatgggattgacggcttggttgctggactcggtacgatctcatttgcaacttatggcctcattgcttggcgtcaagatcaaatcgatatcctgatcgtctgcttagcggtcattggaggattgatcggcttcttcccttacaatcgtaaaccagctaaaattttcatgggtgatgtgggctcccttgcattgggcggtcttttagcagcagtttcaatactgcttcaccaagaatggacattattacttgtcggacttgtctatgtgattgagacagcaagtgtcatgctgcaagtcgcttctttcaaattgactggtaaacgaatttttaaaatgtcgcctattcatcaccattttgaaatgagtggctggtcggaatggaagatcgatacaattttttggctgattgctttaggatgttcgatcatcacattagtgattgtatggtaggagagaggaatcatatgaaaaatataaatgaatatcaaaataaaaaagttcttgtgctaggattagcaaaaagtgggttcagtgcggctaaattgttacatgatttgggcgcgcttgttactgttaatgacggaaaaccctttgccgaaaatccagaagcacaggatcttttggcgttaggcgttaaagtaatcaccggcagtcacccaattgaactactggatgagggtttttcacttgtggtcaaaaatcctgggattccttatgatcagcctattgtccaaaaagcgatcgagaaaaatatcccaatcattacggaagtagagttagcttacaaaatttcggaagcaccgatcattgggatcactggaacgaatggaaagaccacgaccactacgatgatcgctaatgttttaaatacgggatttagtgaaggccgggcattgttgtctggaaatattggctttccagcaagtaacgtcgcccaaaccgctagcgctaaagatcgcttgatcatggaactttccagcttccaattgatggggatcgaaacattacatcccaagattgcagtcatcacgaatatttatgaagctcatctagattatcatggcaatcgatccgaatacgtgcgggctaaatggcggctgcagcaaaatatgacagcagaagattttctagtcatcaattggaaccagccagaattagtcgaactttctcaacaaacaaaagcaaaagtgattccattctcgacacaacaaaaagtggccggtgcgtatctttttgaagagcagttatatttcaaagatgaggcaatcatgcctgtttctgaactgggcgttcccggcagtcacaatgttgaaaatgcattagctgcaatcgcagtggcaaaattagaagggatagcaaatgaggctatcgttcaagcattgcatacatttagcggtgtacctcaccgtactcagtatgttgatacgattgaaggggttcgctttttcaatgattcgaaagccacaaatagcttggcgacagagatggctttaggtggtttccaaaaggatcagttgattttgttggctggaggattggatcgcggcaactcctttgatgagctgattccatcactgcaagatctcaaagcgattgttttgttcggacaaacaaaagagaaacttgctgaagccgcacgtaaagcaggaatcaaaacgattaaattgacagaagatgtaactacagctgttcctttggcttatcaattaagccaaccgggagataccgttttattatcaccggccaatgcaagctgggaccaatacccgaactttgaagtacggggggataaatttatggcggcagtagcagaacttaacagaaatgagcgaagtgaatgaaaatactagtaactggcggtggaaccggcgggcatatttatccggcattgtcttttgtcgattatgttcgttccattgatccaacagctgaatttttatatattggggctacccgtggattagagaacaaaatcgttccaccaaccgggattccttttaagacgttagaaatacaaggctttaaacgaaaactttcattggacaatgtcaaaacagtccaacttttcctgaaaagttatcgtgaagcaaagaaaatactcagagaatttcaaccggatgtagtgatcgggacagggggctatgtctctggtgctgtggtctacgcggcatcagtacttaagatcccaacgatcatccatgaacaaaatagtgttcctggaatcactaataaatttttgaccagatatgtggacaagattgctattgcttttcaggatgcagcacactattttccggataagaagacggtcttggtggggaatccccgcgggcaagaagtaaaaaacagtcagaagtctgcgatccttgcttcctatgaccttgaccctaagaaaaaaactgttttagtctttggcggcagtcaaggagcactgaaaatcaatcaagcgattatcgaagcaattccgctttttgcaaagaaagattatcaactgttatatgcttctggtgaccgttattaccaagaaatcgaagagaagatcggtatgtcgaaagatgcctttccaaatatcagcattcgcccctacatcgatcaaatggcagaagtcatggcgaatagtgacttgttgatcggacgagctggcgctacatcgatcgctgaatttactgcattgggattaccagcgattttgattcctagtccttatgtgacgaatgatcatcaaacaaaaaatgcgcaaagcttagtcaatgctggggcagtcaagatgattgcggacaatgagttgaacagtcaaaatctaattgagtgtgtcgatgcgatcatgagtgatgaaaacgtacggatggaaatggcaaaggcgtcgaaagagcaaggaatcggtgatgcatctgagcgactatttcgacttgtgcaagaggtaatcaaatagtacaatgtgttggatagaaaggagagattgtcatcagtaaagataagaaatctcatgataatcaaaccacccccacgacagaagaattgaccccttggcagaaagaaaatctgcgttatcaaaaagaaaaaggcgatcaacctgtatggtcaccctctgtcatttccgggattcactcagatgaagaacaatcagaagaccaaacagaagaaaagcacgaagaaggcgcagagactgaagattcagaacaagctccccgctcttttgctgatcgattgcccaatttaaaaaaataccgtaatcgagtattgttgcgccgattgctgttgattattggtgttttgctgatcccgttgttatttattctgtattacgtctccccgttgagtaagttagcggatgttaaagtcgtgggcaatgatcaagtgtccgcccaatcaattattgaacattcggaattaacgactggagaagaaatatggccgcagtattttgacagcgaacaaacggaacaagccatcaaaaaagcgttgcctcgtgtcaaaaatgttcaagtgacaatcacttctttaaaccagttcaagattcgggtatcggagtaccaagaggtggcattgctagcaagcgataatcattattcacctattcttgaaagtggtgtcgtggtcaatgaaccgagtgaccagcctctggaaggactacctattttagagagcttttcagatcagtcaaaaatcaaagaagtactgactgcttatcagaagctcagtcaagagattcgtgaaggaatttctcaaatcaagtacacgcctcgggacagtaatgacgagttgttaacgatctatatgaatgatggtaaccaagtgattgtgaacatttcaaatatggctagtcaaatgcagtattatccgcaaatcgcaaaagatttgaaagaagacagtatcatcgatatggaagtgggcatctttacctatccgatttccaatacaaaagacagtgactcggcaacagaacaatcgaccgaaggggattcttaggaaaaattcaagagtttttttcattaacttgtttctaaaaatcgctattatatggtagaattggtaacagtgaacaaattattctaattagatataaatacgaacttttcaaggttcgcgatatatgcaaattaagtaggagggaaccccatccatggcaaaaacgggaatgtatgttggcctcgatattggtacgacatctgtgaaagttgttgtagctgaatacgttgatagccaaatgaacattattggtgtaggaaatgcaaaatcagaaggaatcaaccgcggaatcattgtagacattgacaagacggttcaagccatccaaagagcagtaagacaagcagaagaaaaagcgggtatccaaattcgcagtgtgagcgtgggtgtgccagccaatctgttagaagttgaaaattgccaagggatgattgctgtcaacagcgaatcaaaagaaatcacagatgacgacgtgcgtaacgtagcatcagcagcgctcgttcgatctacacctcctgaaagacagatcattgccattttaccgcaagagtttactgtggatggctttgaagggatcaaagatcctcgcggaatgatcggtgtccgcttggagatgtttggggtagtttatacaggccctaaaacgattttgcacaatattcgcaaatgtgttgaaaagtccggcttgattgttaacgaacttgtaatcacaccactagctttgactgaatcgattttatcagatggcgaaaaagattttggtacgatcgtgattgatattggtggcggtcaaacaacaacttcggtaatgcatgacaaacagttgaaattcacccatgtcaatcaagaaggtggagaatttgtaacaaaagacatctctactgtgttgaatacttctttcaataatgcagaagcgctaaaaatcaattatggtgatgcttatcctgaacgtacatcggcaagcgaagaattcccagtggacgtcattggtaaatctgaacctgtcaaaatcgatgaacggtatcttgctgaaatcatcgaagcacggatggagcaaatctttaataaatcaaaagatgtcttgaatgaaatcgatgcgtttgaattaccaggcggaattattttgactggcggagctgctagcttacctggcgttgtcgatttagcacaggaagtcttcgaaacaaatgtgaaattatacgtgccaaaccatatgggattgagaaatccggttttcactaatgtgatcagtatcgttgattattctgctaatttaagtgaagtttatcagcttgctaaaagcgcgatcacgggtgaacgtacgacgcaacaacctgttgctgttcaacaagagatttcttatgagcagtatgaggctccagaagaaacttatgaagaaccagaagaagagaagaaaggcgaatcgatcacgaatcgtgtaaaagatttcttctcaaatatctttgaataatctaaaacgatactcaggaggaagataaactatggaattttcaattgataacaatatcaatgatggcgctgtaatcaaagttatcggtgtcggcggcggcggcggcaatgctgtcaaccgtatgatcgaagaaaacgttaaaggtgtcgaatttatcgctgccaatacagatgtgcaagcattgaaaaattcaaaagctgaaacagtgatccaattaggccctaaatatactcgcggtctaggtgctggctctcaacctgaagttggagaaaaagcagcagaagaaagtgaagacgcaattcgtgattccttgcaaggcgctgatatgatctttatcactgccggcatgggtggaggtaccggaactggggcagctccgatcgttgcaaaacttgccaaagaaatcggtgcattgacagtcggcgtagtaactcgtccattcacatttgaaggaccaaaacgcggccgtttcgcagctgaaggaattgcaaaactaaaagaaaacgtcgatacattattgatcatctccaacaaccgtttattggaagttgttgacaagaagacaccaatgctggaagcattccgtgaagcagacaatgtattgcgtcaaggggtacaaggaatctctgatctgattactgcaccaggctatgtcaacttggactttgctgacgtgaaaacagtaatggaaaatcaaggaacagcattgatgggtattggtgttgctagcggcgaagaacgtgtcatcgaagcaacgaaaaaggcgatctcttctccattgctagaaacatctatcgatggtgcagaacaagtcttactgaacatcactggcggattagacatgactttatttgaagcacaagatgcttctgatatcgtagcaagtgctgcaacaggcgacgtaaacattattctaggaacttcaatcaatgaagacttaggagatgaaatccgtgtgactgtgattgcaacaggtatcgatccttcaaaaaaggaacgctcttctcgtacaagcagacaaagtcaaatccattcaattccacaaaaaccaacgttagatatggatcaggcgaaaccttcacacgtagaagatgatcatggctttggtgattgggatattcgtaaagaacaaaacgttcgtcctaaagtagaagaaagccaatttgagaatgttgaaaaaaaagaatttgatacattcaatagagatgaagtaaaaacaaatgacgacgatgaattaagtacaccaccattcttccgtcgcaaacgctaggaggcagagcacatgatttctgagaacttgcacaagatccagcaagagatccaggattcttgtgctcttgtttctagaaaagcaagtgaggttcgtctggttgctgtgacaaaatctgtcgatagtgaaaaaacacggaagatcatcgaagccggtgtcactgactgtgcggaaaaccgagtagaaaaactcctggaaaaaaagcagcaactagcagactttccagaagtaaactggcattttattggtaatttgcaacgcagaaaggtaaaatcaattataaatgaagttgattatttccatgcgttagaatcgctgaaattggcgcaagaaattcaaaaacgagcagcaaaaacgattgcttgttttgtagaagtcaatatttcaggtgaagcaagtaaacaaggaattgcaccagacgacgttgtttcatttattgaagagttgcagccctttgataaaatcaatgtcatcggcttgatgaccatggcaccacttgcttcttcagaagcagagcagctcaattattttcatcagttgaaagaattacaagaaaaaatcgcagcgctgcacttggcacatgctccatgtacagaaacaagtatgggaatgagtaatgattttgccgttgcgatccaagcgggtgcgacagttgttcgcatcggcaccgcattatttcaggagtaaaggaggttgacatatgtctttaaaagagaaattgaccaatttttttggattgacagatgaagaagattattacgaagaaagcgtggtagctcaagaatctgtgcgatccccgcaaaatatcgccgtcaatcaaggtagttcttatgttgcaccacgcacgactcgtgctgaaaatccaacgaatacattttcacgaagccatatgccatcacagcaagcgcaagcgcagcgttcaacagcatcaagtgcgtcctttgaaagacaacaacgccctgtccagaagacagaggaaaaggtcgtttctatggcccaacaacgcagtaatcccaaaacaaaagaaataaagtccaaggctgcaggcaagattactatcgtagaaccaagagtttattcagaagcgatgggaatcgcgaaacaagtgatcaatggcgatgcagtacttgttaattttcatttaattgaggagtaccaagcacggcgaatagttgattttttgacgggaacagtgtacgctgaagatggcgatatcaagcgtgttggagatgaaatcttcttatgtacgccaaaaggaatggagatcgagggaactgctcaaacattagcagatagtaatttcttcgatatctgagtcaaggaggaaagcatattttagtctttaggttattaaatctattcagtgatgcagtatatctctatacagtattattagtgatctatgccttgctttcttggtttccgggaggataccaatcagcatttggacgtttcttagcaaaaatctgtgaaccatatctaggtttgtttgatcgtctaaatctgagtttcgctggcatcgactttacgattgcatttgccattatcgttctgcagctagcaacgcaaggtctgttcgttcttctacaagcaatcttattctaacgtaaggggtgaatatcgatgaacgcaaatgtctatcagcattttcgaagcgatgagcacccttttattgattctgcgcaaggctggatcgaacaagtgcagatgcaatacgcaccctatttaacagattttcttgatccgcggcaagcctatattttagaaagtctgattcggcaatcaaccgatttgagttttcaattttttggcggatatgaagctgctgaaagaagacggtgcctgatctacccagactattaccaaccagcaagtgaagaatttgatttggtattattcaccattatctatccaaaaaaattcacggttttaagtcatgggaaggttttaggaacgttaatgggcacaggggtcaaaagggaatactttggtgacatcatttctgatggggaaaattggcaagtatttgtggcaagcgaaatcagtcattttgtccaaacacaggtcgataaaatcgggaatgtctcagttcgcctcgaagaaacgaagtacacggaattgatcgtaccaaaagacggctggagcgaagaacgagaaacggtcagctctctccgtttggatactgtcatttctgctgtctataatatttcgcgccagcgttccaaacaactcatcgagtctggcaaagtgaaagtcaattggacagaaacattacgtccggattttatgttggatctactggatatcgtatcaatcagaggatttgggcgtatccagattcaggggttagaaggcacgacaaaaaaagaaaaagttagattgttattaggtgtattacgtaaataaaacaaagaggtgtaaacttatggcattaactccattagatattcaaaacaaaagcttttcagtaaaaatgcgcggttacaatcaggatgaagtcgatgacttcttagatatgatcgttcgtgattatgaagaagctgttcaaaagaaccgtgaactagaaaaatcattgaagcatgcagaagaaaaacttgagtatttcaatgaattgaaagatgcattgaaccaatcgatcatcgtggctcaagataccgcagacaaagtaaaaacgagcgcaagcaaagaatctgaagtgatcgttacttctgctcaaaaccgtgcagatgaattagtaacgaatgccgaaaaacgcgctcatgcattgacaacagctgcagaagaaaaagccaaagaaattctgacggatgcaaccaataatgcgcgtcaattggcaactgaaaccaatgatttgaagaagaaaacgcgtgttttccacaacaatcttttggttatgctgcaaacacaattagagcaagtaaaaagtccagaatgggaagaaattttggcgccattttctagctatgtaaaagattctcatcaagtaatcaaagaagttttatcaaaagaacttgacagcgaaaatgattctgaagtaaactcagaagcagtggagagtccagtagaaatcgtggaatccagtgagaaagaaattgatgtagaagaaaatccagaagtgaaaacattggatgatgcacgtcaattactagatgaattaaataaaacaaatgactaatatacagaacagaaaaatttcttatacttttaaagcgagtctgggagagtggaagccggataaaaccctgtaagaaattagatcatctgttagtcttggtcttgaacagtggtagagtccaacgtttgatctcgttaccgatcaacaaagaattgtcactgacaataaaatttgggtggtaccacgaacacgttcgtccctttccgggatggatgtgtttttttttatagcttcatagcctatgggcttattagaaggatttggtcgattcaatgagtgaattcactgaaattgaggcaggatagacaaaattgtttgatcgacatgtgcttgcacatgccataatcatgagtaatcagtaaaaggagcgaatacaatgaagatgaaagaaacattgcatctgggaaaaacggcttttccgatgcggggaaatttgcctaatcgcgaaatcgaatggcaaaaagattgggaagaacaaaatatctatcaacaaagacaagcactgaacgaagggaaaccaacatttgtcttacatgatggccctccctatgcgaatggcaatatccacattggtcatgcattaaacaaaattagtaaagacattattgtacgttctaaatcaatgtcaggattccgctcaccttatgtaccaggttgggatacgcatggattgccgatcgaacaagtgctgacaaacaagggcatgaaacgcaaagaaatgacacttgcggaatatcgcaaaaaatgcgaagagtatgctttgacacaagtagatacccaacgtgaggactttaaacgtttaggaatctcaggtgattgggatcatccttacatcactttgacacctgattacgaagctgctgaaatccgcgtattcggaaagatggcagaaaaaggctacatctataaaggattaaagccaatctactggtcaccatccagcgagtcttcattggcagaagcagagatcgaatacaaagatgtcaaatcaccttcgatctatgtcgcttttcctgtagcagatggaaaaggaatccttgatgaagatacatctttcgttatttggacgacgacaccttggacattaccagcaaacttaggaatttcagtaaacccaacgtttacttatgttcaaatcatggcagatggccgtaaatttgtaatcgccaaagatttgttggagactgttcaagcagctattggatgggaaagtgttgaaatcttgcaagaaattgctggagaaaaactagaatacatgactggccagcatcctttctatgatcggacttcattggtgatgctaggtgaccatgtcacgctggaagcaggtactggattggttcatactgctcctgggcacggggaagacgactacatcgtaagcaaaaaatacaaattagatgtcctatctcctgtcgatagtcgtgggatgtttacggaagaagcaccaggatttgaaggaatcttctatgataaagcgaacccaatgatcaccgatttgttagcagaaaaaggtgcattattgaaacttgatttctttgtccatagttatcctcatgattggcggaccaaaaaacctgttatctatcgggcaacaccacaatggtttgcttcaatcgatcaattccgtcaaaacatccttgatgaaatcgagaaagtggactggatcattccttggggcaaaacacgcttgtacaacatgattcgtgatcgaggcgattgggtcatctcacgtcaacgtgcctggggggtaccactgccgattttctacgccgaaaacggcgaagcaatcattacgccagaaacgatcgaacatgttgcaacgctatttgaacaacacggatcaaatatctggtttgaaaaagaagccgaagaattattgcctgcaggctttacgcatccgggttcaccaaatggcaaattctctaaagaaacagatatcatggatgtttggtttgattctggttcttctcatgaagcagtcttgcgtcaacgtccagagttgactttcccagctgacatgtatttggaaggttcagatcaataccgtggatggtttaactcaagtatcaccacaagtgtggcgatcaatggggaagcaccttacaaatcagtcttgtctcaagggtttaccttggatggtgaaggccggaagatgagtaaatctcttggaaataccattgctccagagaaagtaatcaaacaaatgggtgccgatatccttcgcctttgggttagcagtgtagattatgaagcagatgtccgagtttcaatggatattttgaatcaagtctccgaggtttaccgtaagatccgtaatacaatgcgtttcttattagccaatacggctgatttcgatccaaaaacggatatggtttcttatgaaaacttacgctctgtagacaaatacatgctggttcgattaaacgaaacgatcaaaaccattcgtgaagatgggtatgagaaatacaatttcttgcatatctataagacgatcatcaatttcttgactggcgatctttctgctttctatttagactttgcgaaagatgttgtttatatcgaagcggaaaatgatccacaacggcgagcaatgcaaactgtcttttaccaaacggcagtggctttgacaaaattgttgacgccaatcattcctcacacagccgaagaaatctggtctcacttaaaagaagaggaagcctatgttcaactagctgaattgccaagttatgaatcatttgcgaatcaagctgagttgcttgatatgtggacggcatttctttcattccgtgacaatgtcctgaaagcactagaagaagcacggaatgaaaaactgattggtaagtcattggaagcaaaagtgaccatctatccatcacaaccgctggcagacctattaacggctgttgatgctgatttggcccaattattgatcatttcaccagacttcttcgaaatcaaagaggcaggaagtgccgctccagaagcagcgttacaatttgaagatggtgcaatcttgatcgaaaaagccgatggtgaagtttgcgaccgttgtcggcaagtgcggacagatgtcggagtggatgagaaactgccaacactttgcgggcgttgtgctcatttggtggaagaatattatccagaagccgttgctgaaggctttgagaaataaaaattagctgagaaataaaggtaagccaaaaattatcagtgtgccgttggacgatctacttagatcgtccgatggcacacgttttttgtgatcatttcattgtgctgacttagttatcagcttttgtgtctttttcattgttttctcctagcaatagcaactagacgacagcaactgatgataagaagcatagaagtgacaaaaatgcagcgctaggcaatcgtgcttgctttgtcccaatcggttttacccgttcagcgtttttgagagaaagctagaccaacttgcagaaaaagattgcaagatttacatagaaaaggtaaactgttaaaaattggaatattcagaatatttaaagaaaggatgaggggatgagggaaaaagagacattaatgtatgatcctcgttttgaaagtgatgcttgtggcatgggctttatcgtacaaaaagatggattatactcgagaaaactgattgaaaatgcgttgacgatgttagaacgaatgaatcatcgtggcggaacaggagccgaaccagatacaggggatggtgctggtgtgttgatggcattacctgatcctttttttcaagcaattgctttagcggcagagattgttttaccgccgaaaggtcactatgcagtaggcatgttttttttgccgcaagaacgagaatccgcagtcaaattaagaaaggccgttgctcaggatattcagcaaatgggatttcgggtgttgtggcagcgggaagttccctatgactattcgcaatgtggtccaggagcacaaaaagtgatgcctagtttttgtcaattctttattgaaaaacctctcgatgtgacagtcggaagagattttgaggaccgtttgtatcatttgcggcgacaattagaaaaaaactatgcagcccaggaactagccatctgcagtctttctagccaaacaatcgtctataaaggcatgttacatgcttatcaggtcggactgttttattcggacttacaagatccgcgtatgacttccagtatcgcattgactcattctcgtttttcaaccaatacttttcctagctggaatcgcgcgcagccttttcgttttttagcccataatggggaaatcaatacgttaagaggagccgaaaattggatgcatagtcatcaaatcgaagtctatgatgaggaaaattcggactccgcaaaacttgagaattgcatggaattcttgtatcgccaagggagagatttacctcaggcgcttttgatgatggtacctgaagcctggtcgaaagaagccggtttgccagaagaactagttgcttttcatgagtacaatgctagttttatggcaccatgggatggaccggcagcgctttgttttacggatggtgagctggtgggtgctgctttggatcgcaatgggttgcggccttcccgctattcaattacgagggatggcttagttgtcgtagcatccgaatcaggggtggttgatctacccgcagcagaggtaattgaaaaaggggttttaggtccagccaatatgtttttggtcgataccaaaaatggcttgattttgagaaataaagagatcaaagaaaaatatgcgcaagctcatccttatcgcgaatggttgacagaaaatttgttaacgatggatgacttaccagaaccccctttttctgatggattatcgacagagacactacagcggttatggaaacttcacgggtacaccgacgaagtcatccggacactgctgatccctatggctcagacaggagaggaaccggttatctccatgggatttgattcaccattagcaatcttaagtgaacgtccccagtcgctttttacgtactttaagcaactattcgcacaggtaacgaatccaccaattgacgcgattcgcgaaaagctagtgatcggtacagaattatttctgggacgagatggcgatgttacaaaagatcttagccaaaattgccataaattaaaaatcgctagtccgattttaaccacaagcgagtatctgaagatcaaacatctaagtcagaaacaacaatcggcggcagtcctctctactctttattttgtgactggcaatgagcagcaaacactgcaccatgcattggatactctttttaaagaaagtgaagccaaaattgatcaaggggctacgattctcgtgttaagtgatcgcgaacccattgcaccacaactaggtaagatggcaattcctgtcttgttggctgtttcgggtttgcataattacttggtgcgaaaaggaaagcgagcgcttgcctcactcattgttgacacggctgaagtctgcgaagttcatcactatgctatgttagttggctacggtgccagtgggattcatccttacggggcttacgaaacgctgcattattatgacatgagtgatcatgtcgaaaattatcgacaggcctgtgagaagggactcataaagattatgtctcgtatgggaatttcaactattgccggttatcatggtgctcagctctttgaagctgtcggtatctcaccacaagtcactgaggtttattttacgggaactgtttctcggattggcggcctgtcgttgaaacaaatcgaacaagagtattttgagcgatacgaagctgcctatggtgaaaaacaacaggattatctagattcgggaggcagctttcagtttaaagcagaaggtgagcatcacctttttaatcccaaaaccatctatcactttcaaaaagcggtgcgcacaggagattatcagttgtacaaggagtatgcagctgtcatgaatcaagaggctttaagcacacccacgacacttcgttcactatgggagttcacaccttcgcgtcagccaattccattggaggaagtagagcctgctgtccaaatcgtcaaacgattcaaagtaggagcaatgtcttatggatcgctaagtgaggaagctcataaatgtattgctgaggcaatgaatgccatcggagctaaatcaaatagtggagaaggcggggaacatcgcgagcgtttcaaagcggtcaacggcaaaaattacaatagtcggatcaagcaagttgcttctggacgttttggagttaatgcggagtatttaatgagtgccgatgagttgcagatcaagatggctcaaggagcgaagccaggtgaaggcggtcaactgcctggaaataaagttttcccttgggtcgctgagattcgcggatcaacccctggggttcgcttgatttcaccaccccctcatcacgatatttattcgattgaagatttggcacaattgatccatgatttaaagaccatcaacccttatgcgcgaatcaatgtgaagctggttgccagtacgggtgttggaacgattgcaaccggtgttgtcaaggcaggtgctgatgttgttgtaatatcaggctatgatggcggtaccggtgcttctccccgcaattccatcagagatgcgggcttgccttgggaaatggggttagcagaagctcatcaaacattggcactcaatcatcttcgtcagcggatgaccttagaaacggatggtaaattgatgacgggaagggatattgcgattgcggcacttttaggtgctgaagagtacagttttgcttcattggcccttgttgcgatcggctgtgtgatgatgagagtctgcagtctgaatacttgtcccgtgggtattgccacccaaaatccagctttacgaaagttttttgctggtaaaccggaacatattattcatactatgtttttcttagcagaagacctcagagaaatcatggcagaactgggttttcgtaccattgatgagatggtggggcacacagaagtcttggtacctcgtttcattgccaaagggaaagcaaaatcattggatttcgctcgcatcttgggtacgacacttccgattgcacgtaaagtgacggatccttttttggagaaacgacaatggccagaattggatagttttgccaaagcagcaattgaaaaacaacatcctgttgctatcagtcaaccgatcaacaatattcaacgttctgttggtgcccgcatagggggatggattgcagaacgctttgggaactatgaacttcctccaggattgctgcaattcaattatcaaggaattgcgggtcaaagttttggtgcctttgcaacgcaaggacttgagctgagattggttggagaagccaatgattacgtagccaaaggattgagtggtggccgtttgatcattgtaccgccagcagatgctagttatgatattgaacagtcgcccattgtaggtaatgtggcttgctttggggcaaatcgaggagaaggatatttcagaggtctggcaggagaacgtttctgtgttcgaaatagcggagccaaagtggttgtagaaggaatcggcgatcatggctgcgagtatatgactggaggtgtcgctgttattctaggcaagacgggccgcaattttgctgctggcatgtctggaggtgtcgcctatgtgtatgatccggagcaagcgtttgctgctcaatgcaatttagaaatggtggaattgtttaaggtagatgagagcggggatgatgcggtattgaaagaattgatcgagaaccattttgcctatacagattccttaaaagcagccgagattctaagcgattggctctatcataagcagttgttcatcaaagtttatcctaaggaatatcatcaaatggtggaagcgactcatcaattggcgcgacaaggtctctcaggagatgaactgatcgctaaagcttttgagtcagttgtcggtcctcagatgacgatcccaggaaaggagcatgactagtatggcagatccttttggtttcttaaaataccctcgaaaagaaaatccgtatcgtccggtagcagagcggatcactgattggcaagaactgcaagaaccattgccggcaagtgagcggcaagaacaagcagcaagatgtatgaattgtggcattcctttttgtcataccggttctttctatggcgggcaacggacagtttctggatgccccaacgataatttgattcctgaatggaatgatcttgtttatcaaggcaggtttcaagcggcttttgaacggttagcgaaaacgaatccattacctgaaatgaccggacgggtttgtccagctccttgtgagaaaggctgcacggaggcactaaatgggagcggggtcacgattcatgacaatgagcgtttcattatcgacactgcatttgagaatgattgggtccgagcatcgggagaaccgcaagcagcaactggtttcaaaatcgccatcattggcagtggaccagctggtctatccgctgcttggcgcttgaatcagttaggtcatcaagtgacggtttatgaacgcagtgatcgttgcggggggttgctgatgtatggcatccctaatatgaaactagataaaacagtggttcagcgcagaatcgatttgatggcagaactaggcgtgacgttcctaacgaatgtcgaagtcggccgcgacatttctgctgaagaattagaagctgcttatgatcgtgttattatttctactggcgccagtgttccgcgggatttaaagatcccaggaaggtctttgacagggattcagtttgctgttgattatttgacagcagcaaccaaagaggtattgaaccatggaaaagctgcgaatgaatccttggcaggcaaacacgtggtcgtgatcggcggcggagataccggaaatgattgcttagggactgcgatgcgccatggggctgcttctgttcgtcagttggaaatcacgccacagcttccaccacagcgtttagctgaaaatccatggcctgaatacccaatgacagctaaaatcgggtatggtcaggaagaagttgctgcggttctacaggaacatacgtatcacagcatttcgacaactgcttttgtaggagcggaacggggacaggtgattgggatcgaaacagtcaaagtagatgagaattttcagccaatctctggtacagagcaagtgatgaaagccgatttagttttgttggcaatgggcttcttaggtccagaaacacacttgttagacaccttcaatgtccgtgaaatctatgatgattatacaaccaataatgaacgggttttagtagctggtgatgcaaaaagaggtcctagcttagtgatttgggcaattcgagaggggcggctcgctgcggagaaagtcgatcaatcgctgagggccttgatttatcaacaaatttagcaaaaacaacgggaaaaatgcgacagataagacaaataaaccgaaggctatctctgaaaagcgatgcgcaatcttgcgcgaaggacgaatcgtccaagaagcttagcaggtatccttcggttttgttgaatctttcgtcacatagcagatactttgtactgtgcccgcggtccgccgatatatttggggcgtgagcctaatgcagtcacatgagctgcacctaacgttttgatacttggccgaatagggatctgtacgtgtttgacatgcatgccgatggcagtatcaccaatatcgatgccagctttcgcaacgatatgctccacttcaacgggatcaacaaacaagcgaaatgccgctacagaacaagcacctcccgcatgaagtgcagggacaactgccacttcttctaattgataatactgagcagtgctacgctctacagctaatgcacggttcaagtgttcgcatccttgaaccgctaagcgaatgccaagcggatccaacacctctttaatggtcttaataatgatgtagcctacttcttcgctggagtttttgccgatcatcccgccaacgacttcgctagtagaacagcctaaaacaaataaatcattttgcgttaagtgtgctgcgtcaattacttcagttgtgatggttactaagtcatttttaagttgatgaaaatcattcattggaatcttacctctcattcaaagaaaatttttgtgttcgttttaaataattgacaagcggaaatgctaccaatataccaaaaacattttgaacgctattgctgagaatcgaagcaatgcctgctccaaagccaaacatgatggtcgttgctgcggcatagcctaaaatcatcgtcacgcttcccaaacaaagtgccagcaggggatagtgacgaaaacgaccagtaatgtagccttggcagccatggatcaaaatagaaaacaatgcccattctggataaccggacaaaaagtcgatcattccgccgctcaagctgccgacgatcgcacctgaaggaccgcctaataaaagagccgtggtatagatgccggcttcgcaaagggtcacgacaccttttgtctgaggaactggcaggacaaataataaagaaagagcggtagtcagtgctgtcagcatagctaaccttgttagtttcttggtagacatgaggtaactcctttcctaaaataagcaagttgatcgacatttcctaaagattctgtcagctgtagcccattttcaatgccggcaaaaacaaagtctttggcttgctgtacagcatctgtcattgagcggtcagtagccaagagcgcagcgatggcagcggataacgtacaaccggcgccgttcgttgtctgtttgggtgattttggtgtctcaaaaaagaaaaagtcatccccatcatagagcaggtcgcaggcttgctgcccgttcagacgagcgccacctttgatcaacacaaaagcaggcccaagtgctttgatttttttggcagctatcttcatttcttcccgagtagtaatggcttgatttgcgaaatattctgcttcaaccaaattgggagtaacgatagtggctaaagaaaataaggattgcagggcgtgttgatactcttgattggcttttgtctgtccttctttaaaagctaagactggatctaagatgatcgggcagtcttgggtcactaggaaatttttcactaattcgatcgtttccagtgtatgtaataggccgattttgatggctgctaaacgggtgaaagctgtaactgaagctaattggtccttcagcgttgcaggagggatatcataaatggtgatttcctcattgatggctgcgacacaagtgagcaccatgtgaccaaaggtattgaattcttcaaaggtcttgatatctgcagtggcaccaccacctgctaagctgtctaagccagcaatggtcaatacttgtttcattgattcacatcctttagtctttcgttttattatagcgaatggagcaaaaataaaaacagccaattggctgtttttttacccatccaattggctgctgcttattgattatttagtaagttccgttcacgataccattcatctggtttccaaatccattcaaagccatcagctgctaatagatcataggcggcttttggtcccatggtccctgctgaatagttcggaaaatcaggtgtttctttatcccaagcatgtcggatgacatcgacgatgcgccatgattgagcaacttcgtcccaatgagtaaagttggtgccgtccccattcaaagcatctaagagcaatttttcataggcttctggcgtattttctacgatttcagtactattgcggtaatctagtttaacaggaagggtgtcgaatccttgaccgatttctttgccatttagagaaagtgaaaagccttccgtcggttgaatataaatcgtcaagacattaggtgctaatttcttcttgctttcgcaatcagtcacatctttcttgaaaacattcactggaacttgcttgaaaacgatattgatacgggtgcctttctctgttaaacgtttccctgtgcgtacataaaaagggactcctgaccagcggaagttgtcgatcaaaaacttgcctgcgacaaatgtttcggtggcagaatcttccgcaacattcatttcttcacgatacccagcaaactgctgatcctctaattgcccgtgagcatactgtccgcggacaaaattggttttgacttcttcttctgaataaatgcgaatcgcattcaatgctttgattttttctgtacggagttctttttctgagaaagcgactggtggttccatagctagcaaagagagaatctgcaagatgtggttttggaccatatcctttaaggcaccactcttatcataatagccgccgcgttcttcaacgccgagatcttcagcgatattgatttgaacattgtcgatatagcggttgttccattgcgattcaaaaatattattggcaaaacggattgcagaaatattttggatcatttcttttcctagatagtgatcgattcgatagatctcttgctcactgaaaacttgattgatttcttcgttcaattgtttcgcagaggcatagtcacttccgaaaggtttttcaatcaccacacgatggtagccttcggtttcaagcatgccttgtgattttaaatgtgagacgatggtaccaaagaagtttggagacattgccagataaaacagttggtttccttcaagctgatacttctgatctagagaatctgcaagctctttcaatgagtcatagtgagtggtatctgtcacatcatgagactgataataaaaatgtgaagcgaaagtctcagcttgttcttttgactcgatcaaatcttcgatcgttcccataacaacttcacggtaatggtcatctgaccaaggacgacgagccgtaccgattacagcaaaatcctctttaagatcgccttttttatacaaacggaagagggaagggtaaagtttgcgttgtgcaaggtcaccggttccgccaaaaatagtaaaaagcacctttttttccatcgttttcactccttacaatttatctacaaaaatcgtactagctgctttataactgacagcaatttctttatccgcatttttaatggtgatcggtccttcgtaggcagccgtatcaatgatctcaaactcttcatgaatattcaggtcgatggctaccagatagtccaacaattcccgttcatccaacacgcgagcaatccggatctttgtcccgacagggtaagcactcatcgtcgttttttctccttcgtggacgggttgtccctgttcggggatcattccgccgtgaggacaaaacttaggatgtcctagataggcttctaaatgatcagccaatgtccctgatgtgacatgttcaagtacctccgcatcatcgtggacttcattccaagaataattcaaatgctccactaaaaatacttcccataaacgatgtttacgaatgagagcacttgccgaagctagtccgctttcggtcaattggacgccttgataaggagagtgttccactaagccttcttttaaaagcttagaaatcatctcgcttactgaagcagcagacacatccagaccagaaacgatttgtttgttgttgattttcttctgatcaccgcccaattccaagatgagcttcaaataatcttcgcggtttggtgtcatggtattcatcctctcttatcaaagactatcaaactaaattctatcaaaaaaagccacagattactacggaaaaaaccgtgggaagaaggttttttataaaccgctttactttattcgcttattctgacagtcagtttttttaagaagaagaaaactgagagaatgattcatcctctcagtctttttagtgtgtattaagcccaatcgccatttctgaatactgggactgttgtgccatcttctttgattccatcgatggacatttgggcagatcctaccataaagtcaacgtgtgtttggctgcggttgagaccagcagcggccaattcttcttcgctcatttctgttccgccttgtaagctgaatgcataagccgaaccaagagctaagtggtttgaagcattttcatcaaaaagggtgttgaagaaaatgatcccggattgtgagattggtgaaggatcaggaacaagagccacttcgcctaaatgttttgcgccttcatcaatggctaataattttgctaaaacttcttctccttgttctgcagagaaatcaaccactttcccatctttaaaggtgaacttcatcccagagatgatcgttcccgcatagcttaatggtttcgtacttgagatatagccatcgatgcggcgactatcaggagcggtaaatacctcttctgttggcatgtttgccataaacttttcgccacgggcattgaagctgccggcaccttcccataaatggttctttggcaagccgataataatgtctgtgcctggggcagtataatgcaacgctgtgaattgttcttcgttgagttcattagctttttcttgcaacgttttatcatgattcttccaagctgccacagggtcttcttcatagatgcgcgttgttttgaaaatttgatcccaaagcaagtcttgcgcttcttctggtgttgcatcagggaagactttttgtgcccaatcttgaccagcggctgccacaaccgtccagctcactttgttggcttgggttgcttttcgcaagttaatcatggctttccccgaggcggcttgataagtcgctacgcggtctgaatctacacctgctaatgcatcgggattggctgaaaccacactgatacggctcgcaccttttgctacccaatcgtctgtttgatcgattttgtattgaggaatcgtttccaagcgatcgctgtcggcgtgggcaagaaattctttttgaacgacatcatctgtccattgaacgatgacttctgctgcccctaatgcataggctttttttgtcaaaaggcgagccaaaggtgcttgatcaacagcgatttggatgacgatcgtatggcctttttgaacattgacgccaacttctgtgattagttgggcatatttctcaagattttgattaaaatttggtaaaaccattaaaattcctcctaatttttctaactataactttctctatgatagcactatttttttttgaaaacaaatgaaatcgaagtcaaaaaaacagattttttcatgctgaattggaagcaaatagggactaggacaatcttaaaagttgttttgcaatcttaaaaaaacatgatacaatgaataaaaggtttttctgaaagcgatgtatagcagaattaaggagattaaaaaattatggcaagaaagaaaacaattactagagaccagattttaaaagctgcctatgaagttgtcgcaaccgaaggattcacacgttttaccgcacggaatattgcagcgaaaatgaagtgttcaacccaaccgatttacttagaattcaaaaacatggatgaccttaaaagtgccttgatcaatcaaatttatgattatctagcaacagaagtatttcccattgagagacgtggggacgtgatcgtcgatctgactttgaattacattggttttgcgaataaagaaaaacgcttgtatcgcgcgctttacctggaagagtatggcggtggcgattccatgcaaaaattttcttttgatttattcgtcaaatctgtgaaaaaagatccgaaatatcaggatttaacagaagtcgaactgaaatcattgcatacgggtgtatggatcgttgccactggattagccgcattgatgtcttcgggaattcttcatccgacggaagaccaaattgcaaaattgatgaccgagaccgcagaaaatatcattcatcgagaaacaccgattgatatttcatacaagtcattcgatcaataattaaatcatacgtaaagagaaaaaagcatgtacccagcgtgggatacatgcttttttatgtatgcgcatcaaagagatgcaacgatttttttcgcaaagtcttctaagttttgaatgtcttcttcttcggcagccaaatcaactttgacgctttctgctcctttgatagcaccggtcttggcaaaagctgcttcaaaatcatcgacagatttgcaaaaatcatcgtagaacgtgtcacctgaaccgcaaacaccaaatgtttttccactcaggtctaattcttgcaagtcttcatagaaatcaacgatctcgtctggcagttcaccatcaccataggtataagtggctacgatgcaaatatctgcctcttcgaattcatcggcatctacttgcgtacattcattgatatctacctcaatagccagattttcaagtgcttctgcaacgatatcagctatttcttcggtgttgcctgtcatgcttgcgtaaacgattttagctaaagtcataaataagtcctccgatcctttaacggtcaacagtaaaaaccctctctgattatagcaaacccagtcaagaataacaattcttgaaaaaagtcttaggtgaatcagcagactttgtaaaattcttgctttctatggtaaaataagaggaatttaaataagggagacgagaaaatgataacattaaaatctgccagagagattgatcaaatggctgagtccggcgcattacttgcggacgttcataaacaacttcgtacgtttattaaaccggggatcactagctgggatatcgaagtatttgtgagaaattatattgaaagccatggcggaatcgctgcacagatcggctttgaagattataaatatgcgacttgctgcagcatcaacaatgagatttgtcatgggtttccccgaaaaaaagtattaaaaaatggtgatctgatcaaagtagatatgtgtattgatctaaaaggcggaatctccgattcttgctggagttatgtcgtaggtgaatcgaccccagaaatcgatcgtttaatggaagtaacgaaaaaagcgatgtatttgggaatcgaacaagcacaagttgggaatcgaatcggtgatattggtcatgcgatccaaacgtatgcggaaggtgaaggctatggtgttgtccgtgattttgtcggtcatggcattggtccaacgatccacgaagcaccaatgattcctcattatggcgaagcagggaaaggcctacgcttgaaagaagggatggtcatcacgatcgagccgatgatcaacacaggaacttggaaaatgaagatggatccaaatggttggacagcgtacacacttgatggtggattgagttgtcaatatgagcatagcttagctatcacaaaagatggtccacggatcttgacttctcaaggagaagaaggaacctactagaaaagaatggacggatgtcggaggaaccccaaatgaaatggatcgataaggcgaaaagcaatcaaaagcttatgcgatttatagaaacgacacaaacgcggatcacggaatctgaaatgggaacgacctcagttgtcgtagcctattatttattactatccttgtttccattgctgatcgcgatcggaaacttgctgccttttctttcaatcgctcctagtaacgtgctgccctatgtccaagaattgattcctggtcaagtgtatgaatttatcggaccggccattgagaatttgctgacttctggttccggcggcttgttgtctatttcggcacttgcagctctttggtcagccagccaaagcatcaatgcattacaaattgccatgaacaaagcgtttggtgtcgatcagcgttcgaactttattgttgttcgtgcggtctcttttgtcattattctcttgtttatgattgcaatcgtaggtgtgacgatggttattggtttagggaagatcattttggactttctacaaccaatcttccatattcaagatgatttgattgctaccttccaaactgtcaaatggcctttgacgatcattgcgttgctgtttatcttgatgctaatctactggttggtgcctaatgccaaagtaaaacttcggtcaacgcttcctggcgcagtatttgctacggcgggctggatgttgctgtcgcaagtgttcggcttatatgcccgcttttttgctgctaggatcagcggctatcaaatcatcgggagtttcattgtgttgatgatttggctgaatctggcagcaacgatcattattttaggcggcatcatcaacgcagttgtggaagaatatttatcgggacaagagatcaaagaacgaaaagatcccgtggaacgtatctcatcaaaacttgaagatacattttccaataaggagaaataaatgaaagtgagaatgagcgatggaatttgcatttaaatttattgtacgtcttttcatcacgatgatcatatctttgatattgacgcccatcattaaattgatatcctttaaaattggtgcagtcgatcgcccaggagaacgacgaatcaacaccaaaacaatgcctacagcaggaggacttagtattttcctgtccttctcttttgccttgctttgggaatttcgcgaaatgatcccatttaactatgtctggccaatgctcttaggagccgcgatcgttgtagtgactggtttgcttgacgatatctttgagctctctccattacaaaaggtctgtgggttaacgctagcggctttagaaatctattttgtggcggggatcaagatcagtactgtgtcgattccttatatcggtgtattcgatttagggtggttaggcctgccaatgacaattttatggatattggcaatcacaaatgctgtcaatttgattgatgggttagatggactggctagtggagtatcgatcatcagtttgataacgattgggattatcagttacttctttttgcctgattcagtagctgtttcaatggtgatctttactttagtcgctgccatcgtgggattctttccctataacttttatccagcaacgatttttctgggtgatacgggtgctttattcttagggtttatgatttccgttctctcattgcaagggttgaagaatgcgacgtttattaccgtgatcacgcctatgctgattctgggcgtaccaatcaccgatactgtctatgcgatgattcgacggaagttcaacaaacaaaaaatttcttctgctgataaaatgcatcttcatcatcgcttgctttctttaggatttactcatcggggagcagtattgacaatctatgcgttagcaatggtattttcttttattgcactgttgatgaactatgccagtaatacggcaattattctactgatcattagtaccgcatttgggattgaattatttattgaattgattggtttggtgggagagaatcgccaaccattgatgtgcgccttgaaatttctaggtaatcggcgctttcgtcaggaagttttgactaagagaacaggcgactcactagaaacaaccgaggagccaataaaggaaccaacagaatcaaaaacccctcagcggacctcgcgcagaaaacgacgggctaggcataaaaaataatctcggtccatcagtaaaagaacgatccttacatgacatgttcagttgaagctgaaagtcacgtgtgggtcgttctttttttgtatctatccctaaaaggattgtttgcgcaaatcgattatttcaacgttacgatcgacaacgccagattctgtttctaacataatcgattggaaacgctcatttaaattaagctttggttcttggtcgaaataattggctgtatagtctttgatataaataggtccaaccgcagatgagagagtaatggtgtaaggtgcgggaacctctttgtctgagaccagcaagaaacgaaaacttgtatcgagagaacagatccctaatttcgaataaggtccgacaccgtcatccagatccagcagtaaagcaccctcattgctatgatatccttctagtttgttgatgactgcttgtgacatttttagttccatcatgtgttcctccttctttctcttcaatttcattctaagagcatttccctcagaacaaaagtaatctgctttcagcttattgacgtcttgaggctaaaacgtctatactgaatgagaagttatttcagtgaagaaagaaggatggtcaatgccaagtgtacagcaacgagaaacagaaaaaatgggaacagtttatgaagttgaaaatgatagcggtgtcaaacttgtaacaagcccggaaggagcacgcttactggattggatcgtgccgattgatggcggccgagacttagttgttgggtatgatacgatcgcaggacaccagaaagcgcgttattatggcgcaacgattgggccagttgccggcagaattgcaggaacccgatttactatcgacgggaaagagtatcaaacagaagataatgataatggcaatacattgcatggcggatttaagggattggataccgatacttggaaagctgaaacatttgaaacagaaaccgcagctggcgtaatttatcggacagaacgcaaagacggcgatagtggatttccgggcaatgtttcatacacagtgacttatacattggaaaatgatgattcatttacgattacttacgatgccacaaccgatcagcctacactatataatcccacgaatcatggctatttcaatttgaccggtgacactagaaatccaatcgatgatcacatggttcaaatcaatgcagaatatgtggctgaaacgaatcctgatgtcacaacaacaggaaaaaaacaacctgttgctgatacgaagtttgactttcgtgtagcgcgaaaaatgggcacaacattacttgatgatccattcttattggatcatactcaggactgggacttgaaagtgacgagccctgatgaaaaagtttccatcacagttacaacggatcgaccggctgtagtcatctataccacacgagatggcgaagaaggagcaccaatgaaaaccggaccttttgcaaaccatggcggaatggctattgagacccaaggcgttcctggaacagaaaaatatcctcagtttggggagatcctcttacgtccagaaaaacctttccattctgtgactcgttatcgtgttttttattaatcatagataatatatgacctctgtcagttgatctcaaacactacagaggttttttttgacaattttcgattacggatgtaaacttaaatcgtgaacaagcaaggaggaaaaaatatgcaatcatcaagtgctcctataaaaatcagtgattccgaatgggagatcatgcgagtgatttggacattaggaaaatccgatgcccaagaagtcacggcacttcttagcgaatccaaagactggaaaacagcaaccgttaaaacattactaggccgtctagtgaaaaaaggcgtattgcggacagaaacccaaggaaaaaaatttgtttattatcctttggtttccgaggatgctacgattcaaagtgccacagagagtttattctctcatatctgtgcaaaaaaaatcggccaaacattggcagaaatgattcgtgaatcggaactaacgaatgaagatctaacaatgttggaagaggcactggcgcaaaaagaaccggtagccgctattgcttgcaactgtataccgggacaatgtcaatgtacaatgaatgaaggagaataaatcatgaaaaaaatctatcacattgaaggaatgagctgcgaccactgtgttgctcgggtagaaaaagcattgtctgaagtgccaggtgtcaaaaaagcaaaggtaaatttaaagaaagccaatgccaaagtcaaatatgacgaacaacttgttacagatgaagacatcatcgctaaagtaacggaggtggggtacacagccacggttgaataagtctctcgctgctgttcttgaaagatatggaatgaaaaaagttcatttaattgtttgcggaaagacggtaggcaacttctgtcaccccccaacgcgttccagcagggcgcaaaactttccagcaaaaaggaggagtttgagatgagccataacgaaatggacggaggacattcggaaatggatcacagtaagatggatcagagaggacgatatgctatatgaatgattctatcaaaaaaatgctgcgattaatagagaaagatttgatgattacagaggtctcttacgagacctttcagaagaaaaagacgttgatcgtcgatgctgttttcacacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctcccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcactaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttttgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagatcggaagagcacacgtctgaactccagtcactctcgcnnnnnnnnnnnnnnnnnnnnnnnnnnnnnnnnnnnnnnnnaaaaaacaaaaaaagtctggtaatctatagaaaaatacgttatactaaattttgccgaaaggctaggacaatggaggtcttgtgaagcgtgtcagatccggaaggaagcagcactaagcaggagtctccatgtgtctgattgaatccctattagatagccttttggaagacctattttgaatagataacaggtcaaggggcaaaaaaggggcagaattgaaaatttaataatttaaaccataacctagtgattagaatcctaggttatttaatttttctacaatatcggttttttgtttttcagttacatgagtataaattttcaatgtagttttttcatcgtcatggcctactctttgcattatagcttttatgggtatgttcaattcagataataaagaaatgtggctatgcctaaaaatgtgagaatgcagctttttgtttatttttttatccccaagcttctcattattataatctagagcggcattgaatgtattcacttggattggtaatcccgttttgcctataaaaatgtagctgtcgttatcataatgatcatacttcaatttattttctaaaataacttcatccaaaatttcaataactcgattagatattcctattgttctataagatgcatcagtttttggcaattcttttgttgcattcttatagccttttgagtaatctaatgtgccgtgaatatctaggagcttctcttcttttctataattctttacttgtaaacttattgcttcaccaattctaacacctgttaagtacataaactctactagatttcccattcttttagattgatgagacgaatagtatgctgttaataatcgattaacttcttctttttcaaggtacaaatcttggactctagagaatgtttcaagcgttttaggtggtttaggtataattaccttcctcaatggattatcttttacatactgcatatttacagcgtaatcgaaagccatatttaagactgatttgtattttgatttttgaacgtgtgaaaaagtcagtgagttaataaacttttgaaaaaattgactatctgtatttcttatttttgctttcaaattaagattatcattcttcttaaaagacttcataatgtttgtataattacgaatagtatttgatcgtacagtttgagaatgaaaatcccaccattcatccagaagctcttgcaatgtgtggtctgattttttttccgcagttagtatcctgtcgattttttcgtttaattctttttgtgcttgctttttggctacatttgatttgctagttaatgtaatacttactttttttagttcttcagtataagggtctttgtatctttcgatatatttatatttacctttagctaattcctctatccacatattcatcatctcctatttatgataaaataggcacaacaaaataagctatgcctttttagctaatgcactcttactttcgacggtggggtgcatttttttatagctgtacaatataaaccacaacttttccatatattcttaattcttttgcatcctcgtaacttaccactatatctgtgaaggcgatattactggaatcaggtctaaaaataattctctgattttctttatcgttaatgaatctctttactgaaaactcattatcattactaaaaacaacaatatcctcgttcttcaactctgaaaagtcatctatgcgttttactgcaataagtgatccgttaggaatcacattgttcattgaatctccatttgtttttgtaaaaaatatatctgtcattccagaatatttccccatagcgtaatcaggaatagctatttgctcaatgtgatcttcctcaaaggcttcaatagatgttggaaggcctgctgcaatgctagtatcgaaaaaattatagtcatgtgtatcgtgataaaaagctgttatattgtttcctctgtcagtattcatacgacttaaattcatgcccgctttattagctttattgctaagctcaagaaatttttcgaattgttcctcttgagaactacttttcgaattaagtaactcgtcaaaaacttctttcttcatgtcgtgtaaatcgtaatttcgcgaatacctcggatcaatatctgctttatccacattgaaagctgcagctattgcttcggcattttctttgtttattgttgatttttctataaaatatccagaaagtgttgaggttggaattccagttttctcagatacctgggcgcgagtatagccatgagtgattcttttcaagttttctgcgatgattcgtcggatttctttatcttcttgagaaagtggttttcttgccatgttattttgacctcctttttttgttaataatatcgtataaaatcggataaaacaagtataaacgcgtacaataactatgttttttaataaaaaaacaagacaaatacgttgacaactcgtataaactcgtattatagttgtatcacaagagaggagttgaaaaaaagatggttttcaaaattactttagaagcagcgagagttatggccgatttgtcaattagagaagctgcaaaaagctttggtgtgcaccccgaaacgttatctcgttgggagaaagacccatcgaaaatgaaacaaagggatgtaaagaaaattgctgaaatttatggtatccctgtagaaaatattttttttggttctaaaaacgagtttatactactaaataaagagaacggacttttttctttaaataacaaatgaataaaggaagtgtcatggagatggaaatttccaaggttaatgtgattaacgttgttcaaaaatttgccaacaaagaacaagcaatggaatatttcggatttgctaagaaaagtacagctacttttcagagatatttagcagaattcaaacaacataaagatttcgggtccggatatattaacccaactggtggatatgtattgattgacattgataaatttgaacagttcttgagatggaaagacgcgaataaatttcgaggtgatagttgatgaagtattcactagaccaagagttactcattaacaatctcataaaagaaaagattcaagatttgcaccgactcttgcatgataagaaaaatgtggtaagtgatcgacagcaagaaaatgctagaaaggaacttaagcagtatcaagaactactttatcaaaatagattgaatcggcaaatagatttgaggtgagagaaatggaagaaatcaaaggaatagaaaaaaatgagagtgaagatttgttagaaatgtatgaatctgccttttcgggatccgaacaacagctatctttagcagctgtagggacctttaatcgattgattgatcaattcgaaaaagaggaaatccgcacaattgcagaaatcctcaaagctttagctacagccccaactgttttgcagcgttaattttatctttaaccgaaggttgttttttcttccgctcgtcatttacttgcctaatttttgaatcggcaagcgaataagctgcttcgtataattcaaatttctcttggattgtcaaatttggattagaggaagaaacaacagctaaagcaaactcttttgcatcaacaaacaaataatcatctccttttgattatttcagccgaccactgactgataaggagattatacaacagaaaggaaaatttaaaatgaacaacttagtagtcatgaaagatcagcaagcagtaacaacaagtttacaagtagcggaaacttttggaaaaagacacgaccacattcttcgagatattgaaggggtgaaaaaagatgtccccaaaattggggagatctttgtagaaggcaacgaaccggattcttatggtcgagatcgccgtgttgtttatatgaatcgtgacggattcactctgctagcgatgggattcactggtaaaaaggcgcttcagttcaaactgcaatatattgaagcattcaacaaaatggaagatcacatcaagaagcaacagcagttaccaacatcaccacgcgaattggcaaaactggctttagctgctaacgaagaaacaaatcagcgtattgatgacatcaacgggcgtttagtagatatcgaagaaaacaaactgatcactactgaagataaagggactattgatcgagcggttcaaaagaaagtctacgaaatatgcaggaatcaacatcttggccaaggtgctaaaagcatgctgtttcaagacttaggttcaagtatcaaacaattgtttggagttccgaatcgtggtcgtatcaaggacaaggacttctcaagagtattggggttcattgatcattggcagccgtcatcagtgacaaaagagcgtattaatcaaattcaaacagaattggaaatgtgaggaggtaattgctatggaatttgagaacgtcaaagatgcgctaaaaagcgcgatggagtatgccgaatcatcgagtattcaaatagacggaaagccagcaacatatgaggactttcaagaacttatgaaagagcatatctatgctattgcagacttgttgggtattgatgaagtgacggacaacaactggagcgttggataaaggagactgcaaatgaaaagtttacgtagatcagcattcattatcacggtatttttcttaggcgtttggttcggtaatcatcaccagttgccaagttgggcaatcatcgcattaccagtgtcaagtatgtggtggtttttcaaatatgacgagattgcttatagaagacggttaaggaggggagtacaaaatgctgatagaagaaaaacttcatcagttccaatgcaagagctgcaatagaaagaaaatcatcaacgctacagaattgaaaaaatgtgagccgtggaaaggtccctactgcacgaaatgcggcagacgtctcaaggaagtcaagaaattatatacaaaaaaatagcgactccgccggcaagcaaagagtcgcatacaaaacatatctggctacattgtagcacgagaggagaaattttcaaatgattactattactggacttaacgatgacatctatacagcaatgcttgggaatgctcaagagcgagtaattgataacatcatgactgctgccagtcaaggacgtacaagtattacgatcgcaagcaagggactaacacctgccttcttagctcaacttcagaacgaaggtgtggacaatctggtagaacaagacggacgttacaaattattttgggaattttaagaggtgattatatgaatgatttcgattcattaggcgctcgtcaacagcctgaaattgaaacaaatcaggtcgctgttgattggaaaggcgaaccactttacaaaggcgacatcgtctactcaactgatttagggctagttcacgaggaccaaatcatggactatgtaaacgaaaattacagaaaaattgaaatcggaggaatttagaaaatggctaacgaaatggcagttctacaaaaagatattaccgatgttgttttgggtaaagtaaccgaattagaagcacaaggggttcagctgccgagcaattacaatgctgcgaacgctttgaaacaggcattcttcaaaattaacgaagttcagttaagccgcaacgagggtggcggtttgtatatggaaaaatacggaaatacagcagtaggcaaagccagtattgccaattcattgcttgacatgattcaacagggattgaatcccggaaaaaatcaatgctatttcattgcttatggtcaaaagcttcaaatgtcacgctcttactttggaacacaagcggcattgaaaagacttgatgaaatcgaaaacgtaaaagcggaagtgattagaaaaggcgatgtttttagaattggttcagttgataacgaaacagtagtgacagagtttgaaccaagctttgaaaacatggataacgaaatcatcggggcttttgcaacgattacaaagtcagacggcacgaaggtttacacgattatgacgaaaaaacaaatcgataaatcgtggtcgaaggcgaaagttaaatcagtgcaaatcgactttccggaagaaatggcgaaaagaactgtaatcaatcgagcggcgaagcagttcatcaatacaagtgacgatgcagaactattttccgatgctttcaatcgaacaacagaaggcgactatgatcacgaaatcaaacaagccgaacctgtgaaggtacaagcgatcgaaaataaattacagcaaaagttaggcattaagcaatccgaaccaatcgaagaaaaaccgatcgaagaaccgactccgatcgaggatttgataaaaccgaaagaacaagcaatcgaaccagaaccgcttgaccttgatgaaaacgaacaagtggcaaacgatgtcgaaccaatccaagatgacctggggctgattccgaatttcggcagagaggaaggtgccaacgatgaaggaatcctcccagaagaagattacccgttctaagatcaagctcaatgatgataattactacggcaatgaagcggactggcaatacatgtcggtatctcaatacaaaaactttctcaaatgtcctgcggctgctttagccaaactaaaaggtgactggcaaccatcatctgatccaatcgctttattagttggaaactacgttcattcttattttgaggatctagctgttcatgaaaaatttaaggaagaaaataaaaacaggatgttttcttctcggaaaccttatggacttttgaaagatttcaagatcgctgaacagatgattgatcgattgattgtcgaagatgcgttcttgaatttatatcaaggcgaaaaagaagtgatcgtaaccggggaactatttggtgtcgagtggaaggggaaaattgattgcttaaatctcgaagatgactatttcgtagatatcaaaacaagtaaagatattcatgaaagaaaatggaatgaggtttacggtcaacgatgcaccttcattgagaattttgggtacgtcttgcagatggctgtttattgcgaattactcaaacaacaatacggaaaagatttcgttcctataatcgctgcagtttctaagcagacaccaagcgaagcgaagttgatcacgctggacgaggacaaaatgtcattcgagttaatcaacttaagagacaacatcgatcgtattcaacggataaaaatgggtgaagaaaaaccagatgcttgtggaacttgtgagtattgccgggcaaatcaacgaataaccggatttacaagtatgaacgacttgtaaggtggtgagtaaatgaccggaggatggataaagctttaccgccaattactcgaaaaaccaatatggcaagaatctacaccagagcaaaaagtcatattgatcacacttctttctatggcgaatcatgaggaaaaagaatgggaatggcaaggtgaaccttacaaagctaatcctggtcaattcgtcacatcactagaaagtatcaaaaggaaatgcggtaaagggatctctatgcagaatgtaaggactgctctaaagagattcgaaaaatacgaatttctaacaaacaaaccaacaaacaaaaataggcttataaccattgtcaattgggaggtttaccagtccaaggacgttgacctaacaaaggaagtcacaagcaactcacaagcaactaacaagcagctaacaactaacaagaactataagaatgataagaatgaaaagaatataaaagatattacgtcagggaaacgcaaaaagcgcgtttacccagacgacgaccctaataaaattcttgcaaaaactcttttcaaactaatcaaaaagaatcaagacatcaaagaaccgaacttggatgattgggcgaatacaattcgcctaacaatcgaatctgataaacgatcgggcaaggaagttcaagaaatgattgtctgggcaacgcaacatgaattttggagtggcgtgattttatcaccgtccagtttgagaaaacattacgacaagatgaaggctcagaaagaaaatcctattaagaaaagtatcggtcaacgtttgaaatcagaagaagactacgattacaacaaactgccgttttaatgaggtgaaatatggaaacgctaagtcaaggcattcagaaaatgatagcgcagaggctagaagttcgtggcaagtgtccaaactgtgaggggaatatgtacggatggaaagaaaagaaccctgatggttcagagcgttgttctccagtttgtatggcttgtggctactatgatatgcggcgcaaagaagacagagaaactgatcgaatttatcaagaaagcttgaagaaaaaaacaattgacttcttcaagttcggttcagttttgactgataaaagtttgttcgattgcacatttgataattataaacaaatggatgaggaaacaacttcagcagccaagatggcacaacggtttgtcgaatcggtactaaatggcgaaccgaaacacatggtactaggcggtaaatccggaagcggaaaaagccatttatctatggctgcaacgtgggcaattattgaacagtcggattacacgaaaaaatgcttgttcattagttatcgggaatttttagaacagattaaattttcttttaacgacaaagaacttcgcaaacaaattcaaggatcactcatgaaagacatcaaaacagccgatctggttgtggttgatgatctaggagccgagttgggtggaacaaaggcgggtgagagtacagcattcactaatgacataatcaactcaatttttgaagctcgtcagaaccaagcaacgatcattacaacgaacttggttgggaaagaaatggggaaggcgtatggccagcggatcacatcaagaatttttaagaactcagaggaatgttggttcctgttctctaaaacagcagataagcggctagaaagggtgtaaatatggtcaaagatatcaagagagcgaaatatggcaacagtaaggtgttagtagatggcattctctttgattcaaaagccgaagccagatactacaaaatcttgaaacaaaaagggatgagctttctaccaatatcagataatttttgcgaaatgcaaaaaaatatgatcttgcaagagggattttatagtgatggtttgaaggtagctccaatacattatcgagcggatttcgtcatttatgaagaaggcaagctggttaaggtagttgatgtcaaagggtatcaagatgcaatctcgatgttgaaaatgaagatgtttgctaaccgatacgggttcccagtgacattcgcaaagttcaattctaaaaccaatagattcgaggaaatgagttgctttgaatcagctcgtcagcaacgcaaaagagcaagcgatcgccgcaagagaaaattggagggaaccaaatgatggagagctctaaagaatggaatgttcaatttctggacgtaaatggcgatgtcaaatatcaaatcagccaaacctgtacagaatcgaaagcagtaacacttgctcggaagctagagcagatgtggcgaatacgaccggcaaacgatcggagtagtaagaaacaatcgaagctagttgcagttcgatcaagaaaaaatcttttgtaaaaaacaaattggaggaaaataaaaatgactaaacaagtaaactttcgaccagaggtaaaaaaggctacatcaaaatctaacggaaacgtagaagtgctactagtggtaaacaacggatcactgaaaggccgctatgacgatctgagcgactttttaggcaagacagtatcagttacgatccaacctgaaacagtcggctacacgcttcctatcaataaacagactaaacgtccgaacgtcaattatgcagtaaatagcgatggaacaattgaagtcttgaaagaagaacaaacttctttagatgtcggtgatggcgttgaagaaattgaaatggttgagattcaagtttccaaagaaaccattgatgaattcattaaaaatgctacctcattgccattaccggacagcatcacaatcaatcctcgtgatgtattaattcaaatcgaggagggcgagaaaatttccgaagtagctgctgtttatgaaatgtctgaagatgcattgattgatcagattgaaatctctcgtcagtacttcgcaccattcgctgatacttggagcaagaaaaaagatgaagtgatcttcaaagaattatcaggtgattcggatggggaagagtgacggcaaaataattattctggaagatgcaaaattctattggagcgttggcgtgattaaccaagcaaaagatctttttgaaaagggatttaagccatcacaggtagcggaaattatgaacgaaaaagtgattgatatcgggttagtatatctttatttgctggaaacaaaacaattgagaaggtgatcgtatgacctgcagcagatgtaaaggtgaacgtatcatttgggggaaagataaatttggccgggcagtagcaatcaactgcccggattgcaatagaaatggaatcgcggttcggaaagaaacaaaggagtgggaacatgggcatcacggaagttttctgggcaaacgttgattggcatatgaaaaataaaaatcttgttttaagcaaaacgcaaatgattgctaaaagcaaaaggactagcgtcacacttaggacggttggagaaatcgcaaagaaattggatattgatgattattctattttgtttgagcagttggatgatgaaatggcaagtcagcaattggaagaaataaaaaactaagaaaaggggaaaagataatgattgaatatcatgctttagaagacctaaagaaaaaaattgttttcaaaaaaattgtggattgggattccgataaattagttctggaagatgggacagaaaatacaattgaatgctctgaacaggattgttgcgcttgggctggtggatcatttacagatgtgaaattagatgccgttattacagatatacaaattcacgacaaaggacaaaatattttcaatggtgacggtcatgattcctatgcagatgtaattatctatcacaatcaaaatgagattgctaaagcagagtgcgaagctaacgatggaaatggcggatattactatagcatttgtgctttgagagttaaagatatgtggtctgtaattacacaggcatagtcggctatccaccaaaataaccaactgaaggagttttagcaaatgttaacttttgaaaaagtgcaacaaggaaattttgaacttgtttacaagattccgaaagaagtaggacaacgttacgaagaattgacttctttttaccgaggaagagactttaacaaggagattgaaagttatatcgaatcctttgtaaatgactttagatcattcgtcacaccagaaaatgaaaaagctctggacgaaaggcttgttaaatacaacaaattggtagttgagttgcgaaccaatattttgaaagcaacgacaattccatctgtaatgatttccggcggtgcaaactatcccactagaaagaaaaaacgtgaacttgatcgcattcatgagttggaaagggaactatacgccaacgatgggaagcatgaaagatttttagataatacaagaaaaatgtttgatccagttttgatcgaacaaagagaaaacgtagaagctaaacgaaaagctaaagcacaagaagaaggctggcaagcattttatagcgaacttaaacacgaagaaattgctggttatggcatcgatttagaagagaaccgaatttacatcgtaactaacggaaagccgtccgaggatataagaggcttattaaaatcagctgcaatgcgttggtcgcccaaaaataaacgatggcaaagaattttgaccgaaaatgcaatacgagcgattgaaaataagattctcattccgctcaaattatctgaataatagtcagctatccgacgaaatagcagaaagtgaggaagagtgatggaagatcaggtaacaattccagatgttagagaagccatcaaaatggcaagggaaatcacgccgattatgaacaacactgaatacgccacattgatgatcttttacaatcaagttttgaatcggtatcaaaaagaagtctatccagacggattgccagaggaaaattaattccgcaatcgtcagcgatagctgattgtcagagaggtgataaaaatcttagctactgactatatagattctcataaagataagaatgggaacgtgccgatcatactgaattgtggtgtgaagcataagaacagaattatagtcctaaaggtatcagctgattttgcaaagtggatttacttaacatcgggaacaggcgcttactacacaagtgcaataaggaccgttgacaaacaaaatgtattcggagtaacagaattatatgcggatcattttccaaacttgagaatagaggagggataagatggtaccaaaatttagaggtagaaatattgaaacaggggaatgggtgtacgggcatctattttactttgatgacggtcgacacttcatcagcccaacaggaactgatgttgtaggaggatatggcggagcgccagctaagtatagattagaaagtttaatttgctttgaaatcaaaccgaaaacgcttggtcagtccattggtttggaagacaagaacggcgcggaagtttttcaagatgatattgttagatgtagtagaggttgtcctcatgaggtggtttggctacaggaatatgctggcatgtatgttggtggaatgcctgcatggtatctttcagggctaagtgaaggatatgcgtggactggcgaagaggaagttatcggaaacatctatgataacccggaactgtttgagcaagccaatgaaaactagccaagcaatcatattgatactgctgacaatcgcaggtttgagtttgctatcctatacaatagtggaccaacaggaacaaattgaacagttacaagaacaactgcagcgtgagcagatgaagtacaagattattataaacgatccgctggtgagagatgctatggaagcagggggataaatgatggactttgtagtgttagtagccgtggcactttttgcggcagtattcgcaagtgtaattttcggtaaggaattagatgaaaaggagaagcaagccattgccaaagaaaaaatcgaaagtaaaaaagaagaagcgtaagttactagaaaaagccaaggcgaacggaaccataaataaaaaagtccttggtaagactttgaagagtttgatcattgatgaagaacatcaacatggctcacattttgataaataaaaaaagccactaccttttgggtaagtgacctgtgacaagactattttaccataaaggggtggcgtttgtgagatttcaatggcttaaaaactaccaagacttagaagaacaaatactcttcatgaaatggaatcttaacaagagtaggttggaattagatcgatgggtcaacggtgatttagcaaacgtgcgccttgaaaagaattcaagatcatcatcgttggaagaaaatataagaatcattgagaatgaactagagatgcttgagaaagaaaaaattgagctgttggaattaatcgattctttcagcggagcagacaatcaaattgtaaaattaaagtatattgatgacatggatgtttatgatatagcagatgctactggttacagcgtatcttatatcagaaaacggcatacagagattcgcaagacattatcattcgtggatgagtacgaggcaagacgagaggaacgcttaaagaagcaagaagaaatggactactattcagcagaccaggatcagttgagcttgttttgacattgccacaaaatgcgacctcaaagcctgtgtatatttcttgatttaaacgggttatagtaatagcgtagaagaaccggagagccggttattggactactcacaaaattctaaaaaccgaaagggggcaaatcccctcatcgctcattcttcttaacttgaatagaaagacagcacattaatttgatggaggtgattcctcttttcaaaattcgctagtgctgtctttttattatttctataatcggttatcctttaagtataaatttataaaggagattaatgattatgggagaaaaaattgatgcaatcaaaggatttttatttgaaaatgttctatctgttgtttctgaacaaggaaaagatattttaaaagaaaatgtcgtacctcttataacaaacgaacttgcaagacaaggtggtgatattttgattgattatggagctagtttgataccaggtataggtggagctataaccgaatttagaacaaacaaaaaaattaaaaatttagaggtaatggttcaagctattagcaaaagagatgaagagctaaaagaaaaattcgaaaaacaaactttgaagaataaacaaattttagatgaaatttttgaaatggttatgagaaaaattgaatctaccagtcaatcggaaaaaattgagtttatgatcaatggttattcagaattcttaaatttggataatccatcttttgatgtggcttatttatactttgataccctagataaattgactattttagatatttcggttcttaaattatcttatagagctaatacacttgaggatattgacgggtatagcaattatgaagagttacttaaagcttttgatattaactacgatcaatatgttgcaataagggagaatttaaatagattaggtctgatggaaaatgagtatgatgataagcttgttaaagatataaataatcttcaagttgcaattgatgaaatcagagggtctacggagagtatcataaaagctttatctggtgcgagaaatgctaaaattaaaaccttgtcaaataaaagtaaagttagactaaaagcgaaagacagattgaaaatatctaaatttggcagagattttattcgattttttattattaataatccaaatgaataatttttatctaccttagagacgttgtgcaaaggagtgtgattttaaatggctgtgagaggccctacaaggcaacagaaacttttcgtagataattaccttaaaaaccgaaaaaagaaccagacgcaggctgccattgaagctggctatagtcctgcatctgcgagctcacaagcttatcaactccttcaaaatcctatagttttagaatatcttgaaaaacgagaaaagcagttggaaaaggaattgaaacgtgagtttttctttgatgctatagatgctcgaaaagtattatctgatattgtcaataatccggaaagcaaagatgcagatcggattaatgcagcgaaagatttgcttgatcgtgctggctacaaagcagttgatgtccatgagatccaatctactgttaacatcaacgcagacggattgaccgattctgaactggaagaacgcattgccgagcttgaaaaggaattagcatcggctagtgatgacgatggataaaatacaaaaataccgttacttaaaagaattgaagcaattaaaacgagagaagttgttacgccaagcgcgtgatgacttcttttcttattgtcaattacgaataccagacctctataagagtgacaggaaatatttgaaagatctttgccaggagtttgaggaattcatgaagtctgatgacgacatcatgctgctcaatctgccgccacgtcatgcaaaatcaacgactgctggccgttttgttgagtgggaacttggaaaaaatcccaaattaagagttgctactggttcatataacgaagatatggcgaccgatttttcaaaagacgtgagggaaaacatcgctgaagaaagagtaatagatgatcaaattgtttatacggatatctttccgaaagcaaaattgaaacaaggatcagcagcagctaaacgttgggcgctacaaggaagcaagctttcctatctggcgacatcaccaggaggatccgcaactggtaaaggctttgatttactcatagttgatgacgtaatcaaagggattgtagaagcaactaacgaaaatgaactacaaaagcattgggactggttcacaaaacaaatgctttctcgtgttgaaaaaggcggaaaaatcatagtcattatgactagatggcattcgaaagatctggcaggacgtatcattgatgaaatgcctgcgatgggttataagttacgcgttgttataaaaaaagcccttcttaacgaagaaacgcatgaaatgctttgcccagacattttatcttatgaagatttcaaaaagaaacgtgcggcaatgggaacggcaatcgcaaatgcgaattatcagcaagaaccgattgaccaaaaagggcggctttatcaaaagtttcagacatatgataaattgccagacaacgtcattaagatttggaactatacagatactgccgataaaggtgcagactatttatcatctcctgtttgggcagaaacatccgatcacaaggcttatataattgatgttctttatacgaaggaaccgatggaagttacggagaacgcgcatgcgaacatgattgctagaaataaagttaatcaagtacgaattgaaggtaataatggcggccgtggctttaaacggaattctgaaagaaaagcaaaagaaatcggatattatggtgcgtattgggaagacttccaccaatcagcgaataaacaatcgcggatcctgtccaacagcgcttgggtcgaaaacaacgtctactacccggaagattgggcaattcgatggccggaattctatgaagccatgaccacttatcagcgtgagggtaaaaacgcacatgatgatgcgccggattcagttacaggtatcgccgaaacacttcaaatacaaaatcctcaaagcttagaggaacgaatggaagcagccaaattcttttttggctagaaaggaaaagagaaaatggatagtaaaaatattacatttttaagaaaccatcgctaccacaagaacgcaaattctgtttttagaatggcacaagaagatttcgattcggtggaatttgattgtgagatttggatttcacgactagaaaaattcattaatcgacatcaaaatgaacaagtacctagattgaaagaactcaagcggtattctttatctgacaacaatatcaagtaccgtcctgctaagacggatgaatttgcagcagataatcgtattgctagcgattttgcgcgatatatcaccatttttgagcaaggatatatgttaggtcaaccaatccaatacaagaacgatgacgataatatccaagcgcacattgacgatttcaataatagaaacaatgaaacttatcacaatgtattgattaagacggatttatcaatttacggcagggcctatgaattggagactacagtgttagacgaagcaggaagtgcttatgtcaaattagtaaaattaaatccggaacagacctttgttgtttacgacgatacaactgacagcaattctttattcggcgtttattattacacactggattatggtgacggtgttcgcaaagattttattaatgtctatacgtcagacatggtctatatgtatgtaaacagcaatcaagataaaaaaggcatgcatctagtcgattttgacgattatgcatttgacggtgttcctgtaaatgagtttgcaaacaatgaagatcgcactggagcattcgaaccagttttagattcgatcgatgcttatgatctatcacaatctgaactagcaaattatcagcaagatacaatggatgcaatccttgtaattgctggaaatccatatacaggtacggcacaaaatgacttggacgaagaaggaaatattgttcctaactcccggcttgctatttcattagcgttcaaacgtacgaaattgatgtatttggatgacaaccctaatcctaatggcgcgcagccaaacgccttctacttggtaaaggaatatgatactgaaggcgctgaagcctacaagaaacgcttagtgaatgatattttgcgcttcacatttactccggatgtaacagatgataatttttcaggtgtccagtctggagaaagcatgaaatataaattgatggctgcggataatcgtcgcgtcatgcaacaacggttgtttgaaaaaggcttaatgcgacgtctacgcctagcggtgaatatttggcgaatcaaaggcaatgattctattgcttatgatcaaatcaatgatacgaatatcatatttacagccaatgttcctaagtcagacagtgaaattgttgcattggcaagtcagcttgtggggcaagtttctgatgagacactctttgaaattctgaaaacagtcactggtgtagatccagaagttgagttggcacgaattaaagaagaagttggggagaagccattgccaagacgacctgaaacggaggatgaagacgatgaatgaaaagcagttaaaagaactaatgaagatgaatgagaacaatcaaacacttgaagccactttctttgaaatgcaacgcagtttagagtatatagctaaacaaggtaaatgcttatttgataattgtatagcggaaggatttaacgaagaacaagcattaaaatttacgattggtattctaactggtgccgcgaagtaaggagctgatcctaaatggctaaactcaataaatcaccgaaatactggtccggtcgtatggatgaaatcatggcttatgttgatcgaacggatatcgatttcttcgatgagttgcagatcatttacacagaaggccgtcagaacatccagaaggagatttacaacttctacgctaaatgctccaaagaaaacaatatctctattcaggaagcaaagaaacggctcatgcgagaagatctatctgattatcgagcgaatgctgagaagtatttcaaacaagctgaaaaagatcccgaactattgaagcggctgaatgagcagtacaaagccggaaaggtgacacggcttgaagcattgcacctagatatggaatggcacttaggcaaaatgagcggagcattgcataagtcattcgatcgatatctaaaagaagtagctcaatatgcctatcgtaaaataatcggcggaaactctaaaagcacattgaacaaagctgctttggaacagattgtaaaaactccatttaatgggaaaaattattcttccagcatttgggggaatacagatgatcttgccaaagacctaaaaaaagttcttactcaaggatttattcgtggatctggtccagcagatatggctcgtgaattgcgtaaaaaatacaacgtggccaagaacagggcagaagcgatcgtgcgtacagatggaacaaatgttgtgaatctatcagcagctaaacgctttgaagattttggattgaccaagtacaaaaacaatgttcatgttgacgatcggaccactgaaatatgcttgcgagtaaatcgtgaagataaaacttttttgttagttgaatatcaacccggtatcacagcgccaccttatcacgtgggatgccgaactggaattgttccggacgattcagaaataggttatgaagaataggagtgatatctatgatgatgaaatttgtcctaatgcttgttggagtgcctttaatagcattatcgttggttattacaattacaattttaaaaactggatggaacataattaataaaaaagaaccacctgattttgatacaacggaatccaaaagccagcatggcggaaagtgatggtgatccacgtatctcgcagttatgcgttaaatagcgattataggaggtacccatgaatttcaaagaattgaagcgtaagaaagaacgtggtgtgagcaatgaagagttcatggatcaatcaaaagaattctttaaagatgcggaaagtattgttgtggttggtgtacatcagaatggaattatctcgtccttttacacacaaagtacgtccctcaacgctatcggcatgatggaagtagcgaaacaacaactaatacaggaaatggaagcctagttactgactaaggctttttattttgtccaagcgtgatgacattaaaagcatcggaagtgcaagcattgatccacgttaaaagctatggaaggagcaacatatgatgaaaaagaagttatttatgccattgaatctacaatttttcgctgaagatggtggaggaaacgacccgggagatccaacaccaaatttcaacgtggatgaattagatgaagaacaattggcagccattaaggaaaaatttggttttaaagatgacaaagatgttgattctatcattaaaaacaagaaatcaagatggcaaaaggaattagaagaacaaaaaaatgaagctgctagattggcaaagctatctgaagaagatcgccaaaaagccttgattcaaaaggaaaaagaggagttcgagaaagaaaaagaagaattccggaaagagcaattgtatgttgaaaaaggcaaacaactaacggctcaaggaataccagctgattttgcgcatcggattgctggcgatactgctgaagaaatcctagaggatgttaaggctttccgtgcagaatgggataaggcagtagaagcaaaggtcaatgaacgactagcttcaaaaagcaaaacaaaagttggtactggtgctggtcaaatgaccaaagcagaaatcatggcgatcaaagacactgctgaacgccaacgaatgatcgctgcaaacagagaattattttaggaggaaaaaccacatgaaaaatatgtcaaaatcaaacaaagagcgtttattgaaaatgcaattgcagttttttgctgctgaaacaaatttaacaactatggatgatttgggtgaaatcaagtcgattgattttgttagtcgttttgaagcaggtatcaaagacttgcttgctttgttaggtgttactcgattagagcctctttctcaagatttgaaaattcaaatgtataaatggacaactgatgtgaaaagcgggaatgttgctgagggtgaagatatcccattatctaaagtcactcgtactaaaggaccttcacatcaagtgacctttggtaaatggcgtcgtgctgtatctgctgaagcaattgcgcgtcatggtgcttcattggcaattgatcaagcagacaataagttacttcgacaaatccaaggcggtatcaaaacacagttcacaactttcttgggaacagcgccaaccaaaattaatggtgttggattacaaaaagctttagcaagctcatggggaaaattaagtacctttgatgaatttgatggagcagaatttgtttctttcgttaaccctttggacgtttccaattacttgggagataccaaagtattggcagatgcctctaatgtctttggtatgacattgttgaaaaactttacaggcgcgtcgaatgtagttgtcttaaactcagtgccacaaggtaagatttattctactgcagtagataatatcgttctggcttacttggacatgaatgcttcagatcttggtgatatcttcgtcgatttcactgacgaaactggatttatttctgctactcgcggccgtactttgcgcaacgccacttacgaatcactattcatgaatgctatggtgttgttccctgaaattcctacaggcgttgttgaagcaactatcgaagccgtagcgccaactacaacgactacaacgaccgaaggataaggtaggggatagaaatgctagaagacatcaagctgtttctaggtattcaagatgcgttacaagatccgttgcttaatttgattattgaggatagcgagcaacggatcttatccgttttaaatcaatttgctgcaaaaaatgatactgacaagcacaagactattccaacagacctgatctatattcaaagggatgtcgctatcaaacgttttaataaacgcaacagtgaggggactactgcagatagtgaggaaggtcgttcctattcttgggaaccatcttatttgaatgagtatctggatattttcgatgagtatactaagcccacaattcgtgccggcaaaggtatcacgaggttttttagttgaattacaatgatcgcgtcaagataacctatgaaagaaaagtccctggttatcttggagatgatgtcattgaagaaaaggaaacaattgaaccatgcggcaaaactggattatcaaataatgaacaaataggaatctttggaaagtacaatcagaaggcgttcaaattgcatattcaagggatccacaaaggtttttctaaaattgaatacgacggtttggaacgatctgtttatcagacgaagtggcaccgaaattcaacggtggtgattttgacatgagtaaaagcgtgaaaataaaaggcatgaagcaatttattcgaaacgttcagcgaaaagcacctcagttggataaagccattaatcaggaaattaagctttcaagcttgcgtgtggaaaaacgcagtaagaaattggcggcttgggatactggttggatgtcaaacaatatctatgccagtgtagttggtttgatgcaagcagaagttatctcgccagctgaatactctatctttgttgagatgggcactcgattcatgtttgcacagccatttctattcccagcattaaaggcagattggccaatcctgcaaaaacggcttacaaagctagtgagagggtgattgcatgtactctcctatgacagaataccttaaagatgtatctcaaaagctatctaccactggaatttcagtagaatttaagctccctgatcctgaagtcaaggagcctttttatgtgataggcacacacaccggggatgattcacctagtgctaaatttggaccagcgatcgttgatacaagtttgcagatcgatttattttatccgattaacagtcgaacaaatttagaagaagctatttttaaaacgaaagttgcgttaaacaagcgacttactcaccaagtacttattgatagctcagttggtcgagaagtctatcatgtagttttcagaatcaacgaactaataatttaggaggaatgaaacatggctattgtaaataatggcgtcaaaaaaactacaggtaaagcattgactgctaagaaagtctggtattttatccaatcagtttctgcagaaattggctcacctgcgctattgcctgcttttcaaacagaagggggcgtaacatatggcggagaaaatattgatgagcaaactaaaatggggcgtattatcatcaaatcaactgacgagcattcgattgatttgacacaatattttgtaccgaaagacgaagcgatcaaagttgtcaaagatgcaaagaaaaatggaacgtctgtaaaagtttggcgtgtggaaattgatgattctgttgctgaagaagccgaaggagaaactgatgtaaagctatatccagcggaattcggctacggtatgcccgatgatgtggagattgcggacggtgatgatcttgtggaagcttcttacacattaaacattatcggaaaacttcaagaaggtaaattcccattatcaaatgacgatatttcagcaattgaagcactgtatgattaccaaaacccaggtgaaacaactggagactacgatgatattcaaacgactacgaccacaacacaagcaactaccaccacaacgacgcaggagtaggtgagaaaaatgaaatatattctttgtcaacctgctatcaatcgtttcaagtgggaacttgaagtttgtttaactaacttgaagtcgttcggtatcaatgatattgtactgctttttagcgaacatgattcaacaattcctgcttatttagctgataaatacaatgttgaagttcacgtatatagagatgatagagaggataaaggttatattccttctatcaagccttatctgtggtggcaatacttgaaagaagatcctaaacgtgaaaaagagcggtatgtttatattgattcggatgtcattttcaatcaaaagattgatttgcgtaaaatgacttcaaaagaagatgtttggtattgcagtgattgcaaccactacctaaatcttgattatattcgcagttgtgaaaatggagaatctattttgaaaggtatggctgagatcgtaaatgtttcagtggaatcgttggaaaccattaattttaattctggtggtgcacagtgggttataaagaatcctagagcggagtattggaaaaaagtttatttcgattcaaatcgtctttatcaatactttaaaaaagtgaatagcaacattcaaaaatggactgctgaaatgtgggcgcaactttggaatatgatgtatttcaatgttggacctaaaatccacgaagaattatctttttgcttttctacggattcaattgagaaatgtaaacaagtaaaaattcttcataatgcaggagtaaccgaaaaagatcgcgatctattctttaaaggcaagtacgttgatacatcaccatttgaagatgatctatcttttgttaataaaagaaaagcgtcagcaaaatatgtggaagcaattaaaagagttagtcgttagactggctcttttttatttaggaggaatggttaaatgtcttttgatatcaaagtaaaaaacaaagattgcaatatcaaattcaactacgctttaaattttaaagccaataaaaaattgggaactaaagatgcggatggaaattctcaaaacgatggtgccgggattctttttgttcaagttctagagaaagaagatgatgctttagtcaacttgttacaacttgtcgataagaattttaccgaaaatgatgttttagaagctgtacaaaattatacagacaatcttgttaatagcggaatgggtgaagaggaagcctataatcaaatttttgctgatctgaaagaagaaatgttagcatcaggttttttcgtgagcaagatccgcaaatacaaggagaatctggagaaagctcacaaagttatagcggctcgagaaacggaagagtcgaagcttcaagcggacgagttgaagaaattagcggaaagaatcacgaaagagatctcatagtcaactgtgcaaggtatggtttaactgatattgatttgattatgaattgttacttatgggaacttgaagcaattcttgaaggcttgagtttgcgtgaattagacaaacaggaacaaaatgctatttttggatttaatttgcgctatatcttaaatgctaaaaagccacaaatgaaaaaaattattaataaaaaatcagcagaaaatcgaattaagaaagcatttgatcgaaatgctaaacaaacgaaaaaaggtaacaagcgcttggataaagctttgaaagctttggaacactttagaaataggaggtgagatagatgtcaggaagcattaccggatccattaaggctttgattggagcagatactggagactataaaaaggcaatgtcagaggtcgttagtagcactacttcggcaatgagtaaagtgcagtctagcatgactaatagtacaaatagcattgtttcaagggttggaagtattatgggacaattaagctctactattccttcaaaattaaacggattaaaaacaagcatggttgctccttttagtgctgcagggggtcaaattcaacgagtaatcgcatctatcggtgaaaaaattcctcagcccataaaaaaaggctttggagttgtctcaaaagctgcaagcgaaacttcgagcctagttgcaaaaggcttgaatgggatagtgaaaactacaacctcaattggtaccaaggttggtagtgggttaactaatgctttcaacaaagctggaacgaaagcagcatctgcactaagcaaaatgggatctaaaacaaatgatgtaacagatgccactagcggattaatcaaaaaagttgctggaattggtgcagcctatgcaatagcacaaaagggaatatcaatgatctcgggtgctattacaggattagttggagatctcaatgaaggatctgcaacgtggaaaacgttcaatgccaatatggaaaacattggcatggggaaaaaggaaattgctagtgtaaaaaaagaattacaagacttcgcaactcaaacaatctattcagcttccgaaatggctacgacatatagtcagctggcggcagttggtattaaaaacacggataaattagttatgggatttggtggacttgcagccgcagcggaaaatccaacacaagctatgacgactttaagtcaacaagctactcaaatggctgcgaagccaatggttcaatggcaagactttaagttaatgttagaacaaacacctgccgggatcgctgctgttgcgaaacaaatgggaatgtcaacgtctgaaatggttacggctgttcaagacggtacgattaaaacacaggatttctttgatgctattactaaagttggtacaaataaaacattcagcaaaatggcaacagaatataaaactgtcggtcaagctatggacgggttacgtgagacgttgacgaacaagctacagccttcttttgataagctttcgcaagtcggaatcgatgctatcagtaaaattactgataaaatcggcgatttcaacatggataagattaacaaagccatcgacagtgtgatcccaattttggatcattttatcaatgggacaaagttgtcaggtgatgcgctgaagaacatgcagagtgctatctccagaattttaccagttgttgctttgcttggtggcgcgttgacgttgagtggcgctttaccaatgttatcaaagctgacaggcgggttcattaaattttccggtattttatccggccctttaagttcagcatttggaatagtttccggtggtgtcagtggtttaattggactttttccaaaaattggcggtggactttcgtctgcggcaacggttggaatgggcgccttgggcggtatgacttctgcgatggcaacgattatgcaagttgcactagcatctataggaccagccgcaatactaggattagttgttgcagggcttggtttagtaaacaatcaattcggggatcaaattgatcaactgttaaaaatggtcacaacaaagggacctgaagttatttcaaattttgtcaaagggattacttcacagctaccgcaactaattacaagcggaactcaattaattagtaagttggccaatacgattgcaacaatgttgcctgttattgtgcaagctggtgttgatataataggttcactggttggaggagtagcacaaaatttaccatcattaattagttcagcattgaccatcattactactatattgacttctttatctagcgcgttacctcagctaattgtcatgggtatgaatttattgttaagtctgatcaatggtatcgtagaaaacattccacaaattgttagctcggtacaacagattctgcaagcatttgtgggaaatatcgtttcgaacttgccacagataattcaaacaggtattcagatcttactgaatttaattaatgggttgacagaaatgttaccgcaattactaccagtcgctttgaatgctatcttgactttaatcaatggattgatggccaatattcctcaactattaaatggtgccgttcaaattattcaagctttgtgtaattttattgtgcaaaatctgccaatgatcttacaagcagcggttcagattatccaagctttagttagcggtatagtacaaaatctacctaatatcatttcaagtggtattcaaattatcatgtcattggtagcaactatcattcaaatgttgcctagtattttagctgctggttgggatattgttaaatctcttgctagcggtgttttagaagctattcccggagtattaaaaggtgcttgggatggaatcaagaatggatttagtaatttgtgggatacaatcaccggcaaatcaaaatccaaaggcgatgaaatggattctgatacacagtcagctactcaatcagtcgcaagcagttttagtacagcgaactctagcgttagtaaatcgatgtctagcatgcaaatttcagtatcagatttaagcagcattgcttcggtggatgcaacaaaagccgctaagaatgcaaaatctaatactactagtgactattctgcaatggccagtgatgtaacgagctctttaggtagtctacaatctagtgttactagcaatatgaatacagcaacacagaacgctacaagtgctgcgaataccatgcagaacaatgttaataacagcacgtctggcattaatcaaaattctacgaaacagatcacatcaatggctagaagcgtaggtcagtctatgcagaacatggagcaaactgcttcaagtgcaatgcaaagagtatcaagtacggttaacaaaggtttttctagcgtaagtaaagcaagcacgcagtcgatgagccaagcaactcgttcaattagcagcagcacttctcaaatggcttctgcctttagcaatggaatgaataagatggtttctacagcaagaagcgcatcttcgcgtatagtatcagccttttcaagtctgcgataccaaatgaacagtatcggctattacgctggttctgggcttgctagtgggctttcgagttcgtcgggatatatttatagtgtagcaaatagtatcgctgctaatgtacgaagaacgcttcaaagggcattggatatccattcaccttccagagtcactgcttggatgggggaaatgctaggtaaagggcttgggctagggatgcagtcaatgtttggatttgtagccaaacaagctaacgagttcggatccattatcaaagcgcagcagtatcaagcagaagcagttatggttggtgatactactttcactaataaaaatatcagtaccctgactgatgaaatggatcgagatatcgcagaatcagaactcaaaaaggatgaaatctatgtccacaatgaaattgttggagataagatttacacgacagttaaacgtaaagaagcacgtgataaaaataaaaacgattattttaactaaggggggaagatcatggatgctttgatcacaaaagatggagttgaaacgaaactttcctccattgggttacttgtcactgactttcaagacagttcaccttctataaccacgaataaaagagaagtaacaaaccgaagtggatatatattctccggggcagtacacaaagaaaaacggatcgttatttcaggaactttcgttgttcaaagcgcatatgaattagaagaaaagaaggatcagataaatgggcttatcagcaatgatgagcctttttatattaccaaattatttcctactgctggactgtatgattttgaattacctggtcaaaaaacaagcgatttaaatttacttgctattccacatcaagcgtataagtatcgatacaaaataattgtagaaaacgaaatttcatatacatttgttggattatcggctgcaggtttaagaatgaaattttcctttgaaggaagaacagcagaacttccatttggggagactattccaagatcagttactgtttcatcaactattgattacgcaggaactgcaaaatgtagccaattagaatggccatggataatgaagctcacgtcgaatgctatccaaaacggtgatgtgactgtaaaagttggggatagaacatttatctatcatgctgtaacacctatggcaagtggtgatgtattgatgattaaagggatagaaacaacactaaattcgttgaatgtcaatgataaaacgaattacgagcactttattttaacaccatctgcaagtggaaaaatcgctttgacaacaaattttaaaggatcaattcaactactcaatttcgttgaactctataagtagggaggtgattgagtgattaattttattgatgaatacggtaaacaacacgctgcaattgttgagtgtcagaaaacaaagggcgtgaatggcgaaaaatctttatccggtactatctatacaaacgatgaaattttagaaggtattggtcgtggatggcgattacagtttgaagaggaaaattattgtttaacctatgtaaatcctattgacgaaggtaatcgtattgttgttgagttcgatgcggttcatgaattcttttttgatttgagaaaatctgtaatttattccgaaatgaatggttcaaatactgctaatgcctatctgcaattcattttcaatggtagtggttatgaatatcgcttagaagtaaccataccatcttttgaaaaagaaagttttggaatgaaaaatcgccttgatttattcaaagattttatttcttctacaggtgttgagttttcggtaaatgggaaaattgtccgtattcttgaaaaggttggaacaaatctttcaacaatagtaaaaaaaggattcaatttgaatgagcttaggatagaaaaggatccgggttctttcattacctatttgagaggatatggtgctttttttgatcccgatgatgaatctaaggggagattaatagttgagtatttgagtccgcttgctgagttatacggaaaacttgagggcgatcctatcgttgatgaacggtataaagttgaaagtaattttattgatcgtttaaaaaatgatgtggaaagttcttatgggatatcagttgatatcgatatggaagatttaacgaaagctggttatgaatatgatcaaccccatgagggcgattatatcatggcaattaataaggatcttggatttgaacaaaaaattcgaatcatgtcatataccacaagttatgatactgaagggaatattattgatcatgatgtatcatgtggatctgacaatattattcaaaagaagatcaatcaagaaaatgaataccgtaaggaagttcaagctggattagaaaacgcaataagtactgcaaatcaggcttggatttctgctgatggcaaaaacaaggtttttcaaggtccggatagacctacagctacaaataaaggcgatatctggtatcaggtagatggtgaacaaaccatcatgaattactgggatggcttcgattgggtgccatttatcaatccagatgctgttaaggaatcagtcgatcaggccaagcaagctggtgaacaagcgcaagctgctgctgaacaagcatctagcgatgctcaagcagcaaaagtcaaggctgatgcgattcaaattgatgtgaatagtcttgtctctgatgttgctactattaatggtaatgtgactacaattagttcgaaagcaaatgaagcgtatagtaaagcccaagaagtcgagggtaagacagtatcactcgaaaacacagtgagtggttttactggacgtttgacagacatagaaactgtgtcggacgctactaccaaaaaggtaaatgaattagaagtcacagttgatgggcagaagcaaactcttgctactgtgcaaacgacagctaatagcgcattgagcaaggcaaatgttttggagacaacagttgagggtgtaacacaaaccctttccagcgttgagtacaaggttgataacttagatcttacagacacaaatattttacccaaaagtgattactcagataatttgagtacatggactggtgatggcgctactagagaactaataagcgacggaacaatgagaattacttttagtggtagcggcaataaccgtgtttataggggaaatttattcaacttaaagcaaggggacaagttttcagtaagtttctacgcttggtcaaatgtagagggtgcacagattagagttggaacattctataataatcagactgtaactttaacagctccgggtggaggtcctggaaagtattttgagttgcatgaaataaccatgggaactgtatcaaacgccttatctattgttggaattggcacatcatcatttaatgtaagaatccataaaattatggtgactaagggtaataaagcaagaccatgggcattagccccaggagatatggcaacagtttccaaggttaatcagattgagtcaaccgttgagggaactattcaaacagtatcttctgtgaaaaatatagctgattcagccctatctaaagcaagtcaaactgaaaccactgtaaatggactgaaaacaactatttcaactgttgagacaaccgctaattcagctcttacaaaagctacgcaggtcgaaactaccgccaacggtattagacagactgtgaccgaaatgcaaggaagcattgcagacctagtcaataaatttcctgatccagacttccagaagcagaatccaaagcctacagtagaagggtatgggataactgggcaatatgatgcaagtggatttcttattgataatacctcaggaaccgctaagcaaagggtttattggggagctgcacctgttgctttaactgtcggaaaaacttataacatcaaactatacatgaacacaggaagtactggcggaacagtagaaattggctcatctgagggagaaaacattaaggttacgcctcgagcaggatatctcacatgggttcaaggtactatcaaagccacaacatacactgcttttagtatttgggtagaagccggcaaagcagtaaggctacgagaattatatatctatgaagcaaatacagatgttacatctgctcagtttactcaactgtccgacacgatcaattttaaagtgtctaaaggtgatgttatcaaccaaatcaatgtatcaactgaatcaatactgatttccggtaataaagttcacattacaggtcagacaacaattgataacggagtgatcaaaaatgcacaaattgcagacctttctgtatcaactgctaaaattgcgaatgctgcaatcactgatgccaaaatcggcagtctatcagcgactaaaattactacaggcacgttaaatgctgcaaatgttaatattattaatttaaatgcaaatagtattactacgggaacgatcagtgggactaacttatctataaaccttgctactggtgaagtcattttcaacaagggaatcatcaaaaacttagatgatacttttcaaatgaacattactactggagtaaccgcatctagaggtgaatatttatcgccaaatgatacaggtaacactttagcagcaggttataatctgatgaacggtaaaattgagttttatactggaacatttggcgaagcgactgtatcttatggtgggttgacaaccgaaacacattctggtcagtataaagaaaatggtatctggcaagctggcatgtggtcaggaaatagaccagcaattgctttgaaaatggctaatccaaatacaagcgtgtggcaatctgtacacagagccgttcttttatcatcaacagaataccaagaaccattctcgagtagtttttttactgatgctacatggttaggttatggggataaaagcggtgctgatactaaacagaatatccgtggtgctggtattggcgtaaaacaatctggatcagacgtcaacaaagatgagtctggcggtttgttttcggaagcttgggttatagcgagacatggtgtttacttagctagcggttatgcctatgattctacgattagtggacgcagatatttagcacctactattaggctcggtaccacaagagtaaatagtggtgctactgaaagcattaagcaaatggcttcaacagcaacgataactgctggatacaaaatagctatgcagtcgaaatatattgacttatgggctggtgattccggagaaataactctaaatgcacaacgtacagatataaatggtggcggtgattcctcgttatatggtggtataagttttggtgcagactctaatggtgcccgtgtatggtctaaatcgatctataataaaacctattcaagtgggccgcaagtatgcgtcacaagttacgggacccttggtcggattacctctgctcgtaagtataaaatgaatattcaagtagctaataagatagtagctgatgccaagaaaattttggaaatcaatccagtatcatggattgataaatttgaattgagttcggggaacgtaaaaggccgatactatgggtttattgctgatgaatttcacgaaaaagggatgacagaagttgtattctacgatgagaaaggtcaagttgaaggattggcctatgatcgattgacgatgtaccacaacgtaatactctctgatcacgaacgtgaagttcaattgctgaagcaagaagtggaacaattaaaaataagaatacaggagttggaagctgcttagtttctaactcctgttttaatggaggaaattatatgaaaatcacattgaagaacaacgagttagcaccagcaatcaattttttagaaggtatgacgcttaaagcgaataaggacagtcgacaccgtacaaagctggtaaaacgtattcgagaagcctttacagagctttctgatgaggaaaagtctctgatggaaaaattcaatctgcttgatgagagtggccaactcaaagagggcaaagatcaagatgcaaaagatgtggctgctttcaataaagaacaagaaattttgatggatgaagaaattgtgattgagggcggtatgtatgcgcgaaactttgatgaagtcccacggattttgaatgagtacgatggcatgttatctggtaaagatgccgagatctatgatcggttgttagatgaatttgaaaaagaaattgctgaatagtcagtattattaaataaacaggaggaatttatcatggcattaaatactaaaaaatcaatcagcattacaggagaatcgaaaattaatgggcagcaagttatttacctaaatgctaatgtcacaacggatagtgctggaaatacaaatattaaccaatcgattactgaccaaaatctgtaccgtcaaaatcgcgtcgaatgtcgtaaagatattgatgattttcaagcaaaggtttgggcaattgaggatgatttattaaatgaagtggaggagcaggcgtaaagcttgctctttttagtttatgaaagcaggtggcatatgtggaaatagaaaagcaggtccaagcgcatgaggagcggttaaaacagcatgacaaagagttggggcgtcttaatgacattacattagaaatgcaaaagtcaatgaacgaaggacttgcacgagttgatgaatcaaatcgcttcttacgtgagcaaaacacacgacagagcgaacaaaatgctgaaatcctgcgtgctgttttgaatagaaatgaaaaatcagaagaacgggattatgaactaaagatggttgataaaactaacatgtggaaaatgatccttggtattggtgcatcagcaggagctgtatttgcatttgttttagaattaatcaaattttttggaggtagataaacatgaacaacattaattggaaattacgtttgaaaagcaaggcattttggttggcagtgattccagcattggcattagctgtgcaagcaattgctgcagtatttggatttgagtatgattttggcgacctggttaacaaactgatcgtagtagtcaatacagtttttgcagttctggtgattattggcatcgtcaatgatccaacaactacaggtattactgatagcaagcaagccttaacctatgaacagccaaagaaagatacagtcgattatggagatggccaagaattcactgagcgaaaggatgattaaaatgagtattccaacaccagttattttggatattagtgaatggcaaacgccaaacactatcaattatgataagttggccagtgctattgacggtgtaattgttcgtatacagtatggatcaaggtatatcgacaagcactacaaaactcatattgcagaatttcaaaaacgtggtgttccagtagcggtgtacgcttgggttcgaggagtttctaattcagatatggagaaagaggcgatagatttctacaatcgtgctaaagcatataatccaacattctggtggcttgacgtagaagaaaaatcaatgagcgatatgagaactgggattgaaaagtaccgaacaaaattgaaatctctaggtgctaaaaaagtgggggcatatattgcaaaccacttgtatgccggctttaatttagatacttcaaaatttgatggtatctggattcccacatacggttcaaacaatggccagtataatggttcgaatcccacagctacttctaactatgatctccatcagtacacatcaaatggaaaactaagtggctattccggaccgctcgacttgaatcggattgttcgcaaaggatttgaatatctttttggtaagccttctgctagttcaaacaacaatgggtcatctaataactcgacgataggaggaaaaataaaaatgaaaactgtaactttaaaagacaatgttaatttacgtgttagcgcaaatactaatagcaagattattgcaaccttaaaaaagggcagtaaagttgagtttaatgatattgtaactggttcaggctatatttggggtgtacaaccgcgaaatgattcttacaagaaggggtatattgctataggtaagttgtcagattggggaaatattctataatatgcaaaaggcccactcgtttgagtgggcttaatagttctatttaaagactatgtgggttaaaatcatgtctattaatattatgtctattacaatccacaatgttaccctacccctaaaaagagaaacatcttcatggatcttctttctaacatttttaactcccataaaatcactccttatccttttcacaaacaggattatcaataatttcatgatcttctgtactttgtctggtccatgtattaaccatcagaacaaaataaaaaaacaatagaattccccatgctaatatcactaaccaaccatcggttaaatgaagcaaccatgttactacagcaataagtacaatgagcaggacagaatattgaatagtttcttttattcgttcttcttttgttgtcgggtgggaaccagttacaatagatattttcttgttcatgttaagcaatccttttatagttctaagatctcttttttcttcaactcaaattcttcttgtgtaataatccccaaatcaagtaattcttttaattcttttaatcgttgtgtagaagaatgttcatttgatttttcaacagtagtatcttctgtataatcaacatttgcaataaagcgttctaggttactcgcttgtgccgactcaagaaaaacttttatttcttctatagagccattttctaaatttcgtaaaaatattttcccttcactgccaacttcttttatagttgtggttgatttagtatcaaccttactttttcgttttccagcactaccaataattgctcctgctggtcctaatagtgccgcaccagcaatagtttgtcctgtcctaccttttgttttaatattacctgtagttgttgtttcttgggttatagtgctcccattccactcaaaacgctcaaattgatatttagttgcatttggatcatattttttggaaacgtaaaaataatcattaatatctcgtcttaaagtaatcgaatctaattgtttcataaatggttttttcacaggcaagacaatcttttgttctttcttgttttcttgatgattagaaagagcggtactagctgcattttcaattggcttcatcatattcccaatgtttttaccagcaatatctttggatttcaaattatctatttgttctgacatggcttttgtagctttgtcttttaccttatcaaacagtcccattttaaaaactcctcacttttttcttttattgtatcagaaaatattgtaagaataaaaaacatttcaacgataaaatcgtttattaaccgaagatgttatttttttagaacaataatattgggggcaaaaaaggggcaataaaatgataattcatgataattagtgcaattatattttatctagaaacagcgaaaattattgctgtgatagtaatagatagtccatatacattggttaagtattttaagcaggagtctccatgtgtctgattttttttaattaactattagctgatgaaaatcagctttttttgttgccaaaaagcagaactgcgacttctctaagtgagttcttctgagggggtagacaaacgccctttttttatatccttcattcaataataaataaaaaaaggggctgtgccataagtctcctacaagtgaaatccgaacatgatatagtattgctcttgcggtgcaggggttcctcgtcgcaaaagtcagaggaatctaaaacgttaatgccacgatcatataagatttcttgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaaccattttgatcacttcaggattggaaagcatcaaaagtgcttatgaagacgctttgtcgatcattgatcacgtccaacaagtcaaacacaaaaaagagatcctcgaaaaagggatcttgagtcaacagcaagacttgctgctttatgatgatacgtataccattgaattttctacattagaaccagattttgcagaagagatcctcaaagttcttcaggccaaaccagaaaagaaagaaatccagcactactcgcaaacacaaaataagtatgtttccttattaatcaaaccgtatactgtcgatcagcagcattatcacagctgcgctgttcaagagaatagtgcaccacccgtaaccaacaaactagatatcacttatcagaaaaaaacagaagtcgctgatagtttttcaaaaaagttattgttttcgcaatttatacctgaacgcgtcaagcatgaagtgaaaaaatacgaagattactattcttcttatcttgtcttcggggagagtggcactgccaaaaaaaatattgcttaccaaatttatctaaatcagaccaaaaataccaactacctgatctcgatcaattgcaaactcgtcacagataaactttggaaatttctagtcaatgccaccaatggtccctttgtcgacagccataacaccattttctttgagaatgttgagcaattgaacgcagcagcaatcgaacgcattgtctcattgatcaaaaccaccaatgtgcggaatcataatcagctgatctttacctatgacaacaataaagcagcggatcaaacgactttcaaccgactggcaagccaattaaactgtgcgaaaatctatgcaccagcgattcgggaacgaaaaaatgaattaagtatcatcacgacattgcttttgaataaaatgaacattgcctgcaacaaagaaatcatgggcttcgagccgaaagccctcgaatcattcatagcttttgactggcctggcaatttcgatcagctgcaatactgcatcaaagaactggtggtcaatgcccgcacccattatattaccgaacaccaagtcacagaattgctgaacaaagaacgactggttcaaaatttcacccatctcaaggatcattttactgccaaaaatcctttacatcaccccacgttgtttgactacaccaaagaaatcattttgagcgtgttagaacaaaatgaaggcaaccagaccaagacagcgaatcagttaggaatcagcagaaccaccctctggcgctacctgaaagaagagcagttgtagtgagtgaccaccaaaacgtaaaatcccttgctagcacttctgaaagaatagtcgaaagtgtaagcagggattttgccctgttcattacttctaattctctaaaaacgcttttcactcataactagccatgatctttttgatacagtctaaataatccttccgcaatatctctggggaaataatttctacgtgttcaccgaagccgagaaaataattggtcataaaccgcaattctgtctgatcgaatttcccttcgatccacgttcccgtttctctttggcaaagagacatattggaaaatggatgcttcaaaaaatattctttccctgtttcactgaccttagccttgaagggaatgtttcgataggtttgcatttgcttctggtacgaatccagcaactcctcttttgcatacaaggtttgatagggtgtttccaccacgatcgatgccataaaatcgcaacggtaggtccgccatgcttcttttgttaaatcgaatgccgtacaataccagtagccatccattagaatcagtcgagtcggcaacagccgtttttgttgcaaaccgtagcgtgtatactccactgtgatgatcgcatttgtcaaaatacattcaaacaactgttccaaattttcagtcgtggcgatttgactgattccttcatactgcacacaatccaacatagtcgcgatttgctgctgtttctcctttgggaaggtatgcaacaatttttcttgtagctggccataagtagcgccaaatggtgaatcggtcaataatttcaatagttgtaaggaataaaaaatggcgaagacctctttttcgctaaagtaaatgggcggcaacaacgtattttgcaagacctgataaccaccatagcgtccattctcgacatatagtggcacccctagtgcttcaagttcttgaatatcacgaagtgctgtgctctttgaaatagcaaaagtctccatcaattcctttaaatgaaagactttcttttcattgatataaaacatttcttgttggattctttctgtttttttcatattctcctccaaaggtgtcatgaaatgaaaccattaactgttacagttagtttatcatagagaaaaggagaattgattatggcatccatcgatgtagcactttttttgaccttagaaggaaaaggaacagaagcactggctttctatcaggatatttttgatggaaaactattatttaaaatgacgtttcaagaatttaaaacccaattggctcccgatactgtgattgaaactggcaccgagcattggctttcccacgcagtactgcaaataggccagacgcaaatgcagttgacagatcaacccattgatcctagtcttccttgccagcaaggaaataccttgtcattgagtgtcattacggatacgatcgaaaaagcacaaaccatttacgagaaattgagccaacaccaattgagcaagatctatcagtctcctattcaaaatgaatttgcggacttctatgccatcttgcaagatccgtttggtttggtcattcaaatcaccaaagaaaaaacactttctgatgagtaggaggaaaatcaatgcgtcagtatcaaacaaaagcagaattgatccaaaccattcaagacacgtttcaaaaatacatcaccgaatttgaggagattccagaagaatggagacaccagcaccatgatgaggtagataaaagtccctctgaaaatttgtcttatcaactagggtggctccatcttctattagactgggaagcccaagaaaaaaacggcgttgctgtgcaaacaccagcagcaggctataagtggaatcagttaggtgcactttatgatcaattttatcagcgctatgggcagctttccctaaaagaacagcaacagcagttgacccaactggtggaggaactatgccaatggatcagcacactatcagataccgaactgtttgagcccggacagagaaagtgggccacaaccaaagcacaatggcccctgtataaatggatccacattaattcagtggcgccattcactaatttccgaacaaaaatcagaaaatggaaacgattggtgatggcctaaaatgcggcaatcagagaaattgatgactgcattattgaagatgcaccatatagctggccccactaagattcaaacggagagacaaaacagcgtgtatgaaggcatgactttcgttgttggaaacacgacttttcgtagccgtctggcgaagaaaacaccaaagaaaaaaggctatttcactgcattgtgggagcaacctcatgaaaagaatcaagcttattcattaagcggctatccagacaaactaatgattactgtccttgatggcaagcaaaaaggccaatttgtcttcccatcttctgttcttgtcgccaacggcatcatcaaaacagaaacaaccgcaggaaaaatggcttttcgcgtgtatccaccatgggtgcaggacttaaatcctaccgcatcccgaacacaaaactggcaaacgccttatttcctcgatttatctgaacctctcaagcagactgaaaccctagaaaagttttactttcactgaaaaaaggcttagaagatgtccgcgcttctgagcttttttctctcatcccgtctctaatttcctttattagcaaaaatcttatttttcctttgacagattccaaactattttgtacactaaataaaacaatttaaatattctgaaaatttaaacaaaggaagtgattgaatgactgttagtagaagaaaggcaattattttattattatagtcgggactgtttgagtattttattcaaagagtccctattcacattgcaccagaagaacagagaatcttcttgggtggaatgtttttttataccctttttaaagctttgcttgttgaaaacttttgctggtagctgtgctggttttctattgattcctctgatccgcagcatctcaggtgttggaaacggtgataggattgctagtccctttacgtcaagatggaaggaaagtcttaatgaatacaataaattcgattgccaaatttgtgaataaatacctgatttatctcatggtccttttgatgctgatctcctacctgtttccccaaccatttttgtggatacctacgcgcacaacaacgttactaagcatcatcatgttttgtatgggaatgacgttaaatgtcactgcttttaaaatggtggtgattcagccaaaagcttttcttttaggtttattgatccaatttaccatcagcccgcttgttgcttatggcttggcacagcttttcggattatcctccggactgatcatcggttttgtcttgctgggttctgtttcaggaggaaccgccagcaacgtgatgaccttcatcggcaagggagatgtcgcattgacggtctctttgaccactatctccacactaatggcaacagtggtgaccccttttcttgtctattttttagctggacagtatacagaaatctcatttttcgccatgcttttgtcggttttgcagatggtactactgccgattcttttagggatcatcgtccatacgcttattgccaactatatcgatgcgtggatgcaggcttttgttttagtctcttccgtcagcatccttttgatcgttgcaggaactgtggcgaaaaacgggtcagtgatcgttcagtctggaataatcgtcatcttccttgtcttgttgcataatcttatcggttacggtgcaggctacgggattagccgcctactaggtgtcagtgaccaacaggccaagtcgatcatgtttcaattaggaatgaaaaataccggattagccatctccttagcgaatgcccatttcgccacgatcgctgctgccgttactccagctgctgttggcatgatcattcatcaaatcacaggaccaatattagcgaatatcgtcgcaaagaaagaaggaaaacaatatgagtcaaagtatctttttgccaaattatacgatcggaacagacgcttacgaaaaagtaaatgatatcgttaaaagttatgggacaaaagctgttctgattggtggaaaaacagcactagcgaaagcagagcacaaaatcaagtctgccttgacacaagacgtattcgtcattgacagcctatggtatggtggaaattctacctatgaaaatgtttcacgcttactgcaggaagaaagtgtccaagcagcggagatcttatttgccgtcggtggcgggcgtgtgtgtgataccgtcaaagtcgtgggtgagaaattagccaagcccgtcttcacatttccgacgattggctcaaattgttctcccgttacagccgtatgtgtgatctacaccgaagcaggcgaaatgcatggcttgttctttccttcaaaaccgccggtccatgcctttattgatacagccattatcgccgcagcgccggatagttacctgtgggccggcatcggtgacgccttatcgaaagaaatcgaagccactttttcttccagaggggatcaattggatcataccgatgcattaggcattcagatcagcaaaatgtgcacggagcgcttattgacctacggcacgcaagcgttgaaagacagtgccgccaatcgcccctcggatgccatccaacaagtcgtctcagatatcatcgtgaccaccgggttagtatctgtcttagtcatcaatgactacaattctgccatggcccattcgttctattatggtacgactgttctggaaaaaatggagaattatctgcatggggcttctgtcagctacggcgttctagcattgttgatgatggatcagcaaaccgaactctttcaacgagtctatgcttttatgaaagaaaacaagctgcccgtctgtttggctgacatgcacctcaatgcccaatcggacttggaagccatcttagataaagccatgaccaccaacgacattgttcatgtaccctatcccatcactcgcgagatgttccagcaagccattcttgctgtagaagcctatcatgccaaacaagaaaagcagcagtacactactattggataaataccacgaataaaccaagaatctttctaccaacaaagtaagcaaaaaagagcagctcgagttgattcgcgctgctctttttctattacggcttatcaattaactaaggaattcattttcaactaatcgtggtcttatcggctgaacaatcgttgcgccattctactaccttttggaaatagtcatttgttatgagagagaaacgactgaccaattactttggcggatgatcgccgatagtgatagaatctctcctttctcaatgagtcgttttgtccagtgattggatcacttctctaagttggctgcaggattgggcaaatttttgcttctcggctgggtcgatattcagctcaatgatttcccgcacccctccttggtcaaccaccgaagggacacctgtaaatagatccttttcgccgtattccccatcgagataggcagagacaggcaatactgcttgctcattgttcaagattgctcgaacgattctggcaacactcataccgataccatagaaggtggcttttttacgattgataatctcataagcgctatttttcacccgatcagaaatggttgtcaaatcttcgacagtcaatcgatggtttttgacgataaactctagcaacggttttccccctactgtcgtatgtgaccagactgctacttcagagtccccatgctcgccaataatgtagccatggatacttcttgggtcaatctctaatttttgcgccaattctttacggaatctggtggtatctagcgttgtcccagttccaacgacgcggttgcttggcagacccgatgcttgccaagcaacgtgtgtcaatacatccacagggttagaagcaatgactaaaatcccatcaaaacctgaccccatcacttctcttacaacactagtcatgatccccgcgttgacatcgattagttccaaccgtgtttgtcctggtttttggttgacacctgccgtgatcaccacgatatctgcatcctggcaatcagtatagtcgccagcccaaactttgatgttttcctgggcccatgacatcccatccaataaatcaagggcttctccttccgccttttcacgatccacatcgatcaaaaccaattcattgatcagcccttggttgatcattgagtaagcaatacttgttcctacaaatccagttccaacgacaactacttttctacttgtatttctcatatgaacccacatccttttctattatttagaaacaatatgactttcatttatcccgcaataacaacaattttcttactcgaacttacaaagacacgtccattaataccttaacattcatgatctgcgatcaaactctttgtctgactatacaaatgaacgaagtatttcagcaatacatagcaaaccattgcgatagctaatactgtttcaactatactcaataactcagtcactccaaataaaattgggcgatccataaagaattgagaagacttgaacattgctgttgctgaaatgactaatgggaatgtgaaggctgcataacttggataaaagccaacttccagcatttttttcatgtaaaataccacgcagaaataaattgcttgggacaataccagcatcaaagctacaaataaagccgatccttctttaaagactgacagatagccagctaaacaaagggagccaggggcggtcaaaattgtgatcaaaggtactgctgaagcttctgtcatcttttggaacataattcgttttagaatcactggtagtagagtaaaatatagaaccagtgcaatccatacaacgatttcccccagttctttgataaagactgctgatgtatttggaatcactccaatgccgacaaaagtaataaaccagcttggatacacatattccaacgtaatgtcgacaggtaaaatatgaacgacaacaaaataagtcatgagacccaaatgcaacccgattgatgtcagccatagcaagtcattcatcagtaaattaggaaatactcgctccaacactaccgagatcaccatcaaagacatggtaaaagtaggtgcaacagaagcgatgatcggatttttcaaatccgctaatgtgtgtttaaatgtgaaaaacagcttaagaaggaacaatcccataatcaaaataccaatcaaacaaaagatattgccgattgcttcgaacccttcggcaaacaataaatttcctaacgaaaccgttcctaaaatcaacccacaaataggtatcggaattgcattcaaaaaattttttagtgattgattcattgatccatcctttctgaacgattaaaaatttctatcgtacttgtgttatcttttgtagtcatctataatataaccacgaattaactatttgtaaaataacgattttatatatccgttataaattatattaatagaaaaaggtgggattcttttgtttgaactattaaaaacattcgttgtcgtttatgaaactaggaattttagtgttgccgccaaacaaatgtttaagacccagccaaccatctccgtccaaattcaaaaattggagaccgagttagggttcaaactctttgaacgcaaaggaaaacaattgattctacccacgaaacaagcagaattcttgtaccctaaagtggtggattcgttaaattcgttagctagtgtctttgcacaagctaaaaatgccaaagatttcaagacggactgcgtattggcttgctccaatacaactggtgttcacctactcccaacgatcatgggccagctgatcgaacactttccattcattgctttcgaaatcaaaatcatgaattctcaggaagtcattgatgccgtggaagccaacaaagcccatatcggactgatcgaaaaagccatcgtctctcctttgatccaaaaagagttcgtctataaagacgaacttgttctagcaggagatattgattccgatttctggatcctcagagagaatgattccggaatgtactatatcaatgaaacgtatctttactcgaatcatttgaacccgcagatcattaaagccaacaatagcgaaatgattctagcactactggagaataacatcggcaagtcgatcatttccaaacttgccctcacagacacattgaattggcaagaactagccccagagtatcgctaccgagacctgtttattatccagaacgtccaaagcccctacccagaaacagccgtagtttatgacgtgatcaaagacttactgatccagctgtcggaagaaacagatgcctaagaaaacaacacaaaaagcagctcacctactgatgagctgctttttattcctatctcaaaattatctgaaaaaatgtttttattagggtgattagcaaggttgacaattatagatttcagctacaaaacttaacgtttttttgtctcttaagcattggataatgaccggtacaccctaccaaacagcaagagataatgaagcgtttcaatgatctgtaaaaatagcaagaagatttcctgaatgattaatcaactacattgccgacaaattaactaacacttacttgctcattttatcttgtttttactttacttattggaagaacttgcatgtctattatgactaattggagcagttcttgtatggatttttattactggaaaaaacactcttcctctatcttctatcccctaccaacacttgccatcgttcattcgtcttcaaccaagaaaaggtttcttcatcactaaacatgcggaataaattctcgtaaagtccgttaacgaagttgctgtcgatttccttaaatgtcatgtgttcatacaacgttgagtgggtgaaatcattggttttagcaacactggcgatgattttctccattgtttcaaccgttctctccgcgtctttttctgcgatggctaagtcaagatcactggatacctcgtgatattcccccatttcaaataattttgctaattctgactgtttctttattagcaaatgtgcctttgcattattctcatccttcatagccaaaagatataattgttggaataccatactcatcctttgataaccagaaaacagcagctcctcatatgcttgataggcttccgctactcgtccggtcttactgtaaagataggcttgtttgctttttctctctgggttctgattggaaaaataatggaggtagctttctgctttctcgtacgcttcttttcgtacgtaaaatccaaacaaagaatcggctgctcgatttctggtatcttcatcccgactttctaacgcccgttcgtaccaacgatgaatgtgcttctggtatgtttctttagcgggaacagcttgttccaatagctgcacatctaaaagcagtgctacttggccaatcaattgttcacaatttgggtaggtatccaaaatttctttggcccagcgaaatacatcttcaaaaggttgatttttaagcttatgatccagttcacgaatgatctgattgatttcggttaccgtgagttctttttcaaatgagaataacgtatcaagactaatatctagtaagcgtgcaattggcgctagcaacaagatatctggatgtgaatgccccttttcccacttatttactgctggcgctgtcacaccaaggcgcttggctaactcttcctgtgttaatccttttttcttccggtactggcgaatcacttcccccatttccatcgctgtggtctccttttcggtgaatattgataactactttgatcataacaagaatccgaacacgcaacaattgactaaatgaatcaattttctaaaaaaaaattaaccagtggttataagagcaatcaaagcggacacagaaaacttgtcccttagttgtttttgtagcaatcttgacgcaaaaaagacacccatctctgagtgtcttaccaatgactgattccccatctagtaaacagtctttatgcttcacttatttgacgattttcttgaccatgtcgaataatgttttcacatcttctggtcgcgtatcgccagtttctttgtcaataatcgaactgtaaatatgcggaatcacttttttaacgcctgcatcaatggcgatttgcagaatttcttcgaagttttccagatcaattcctccggttggttctaaataaaaatcatatttggcgcaagcttccgcaactgctttgaattcttctttgtgcgctaaccctttcattgggaagtatttaatggaacttccacccatgtcttgcagcattttaatggcggtctcgatggggacctctgccgccggtgcctgtgaacttaaaggtccagtggcaatattgacgtaccctaccttgcctgttggtgaaaccaatccattgatgactgtatcgttttgtcccaataaagcacgggaagttcctacaccagtgaatacttgattgacatgttgcggttgtaaagtaccagatagacgggaaaccatctgactttggttgggatctccggcgcccaacccaacggacaatgcattatccgttgccgcttgatattttttcatgtcttcgatcgctgcttcatcgctagtatagttttttgataacacacctagtacgacatgtcctgctgctgcttcataacaagccttcgcattttcaactgaatgagccaatacatttaaacatacgcgatctttataataatttggaataactgacaatttaaaagcctcctacatgatttcttttaagcgtttaatgattttttccatttcgttttggttgaccgagcgaatatcaaactcaataattccattatttgcttgatattcacgtgtgtagactgctgggttttgtgcctttagttcttcaatgacttctttcgcagatttcttgccagcaaccgtgacacttgcgcgataaatatctctcccggcgccatcttgaacaattttcgctgataaatcaggaagttgattgatcgccgccacgaaaggtgccaatcgttgtttcatggactcaccggattcactgccattttgcaggtaatcttctactgcttgtgtaaagcctaaaatattgtctttgccgattttcattgcccgaccgatccctttagactgtagacgaatccattgaatgtattcctttttccctatgaccagaccggcactcggaccttcgattgctttggcgccagaatagataacaaggtcggcacccatttcactgtatttgaacaagtcttcttccgcggctgcgtcaacgatcaatggcaagtgatgggctttggcaacttctaccatctccgacaccgttagcatacttttctgcacggtatgatggcttttaatatatagaagtgcggctgtttcttccgtgatcatcctagcgacatgctccggtgtacacatatttgcataacccgcttcgacgacttgtccacccccttgagcaaccattacttcaaccggtgtgccgtagtctacattgtgacccttaggtacgacgatctcccgtctcgtgattttttccgtgtagggatgataaacatggtacaggtcgccttgaccaatcaaagccgcgacagattgggcaatccctgctgaagcagaagaaacgatctgcgcatcttccaccttcaataactgagaaaggtaggcgccagttttcacagccagatcactcatttcaaaaaaatgttcgccgccaaatcgttgtgcggctagcacattttcagatactttcgagacaccgagtatcgtcatttttcccgaggcattgatgacttcctttaaagcaaacttttcatagctaattgtcataaatgacgcctccaataattgtttggactggaacaatttgttctttcgctatccgtgtaaccccattggaatctttcagttctttttcattttcgacaatctcaaagatcgtcaaatcggcatcaaaaccaacagtcaattgacctttcttcgccaagtggaagtttttggcaggaactgaggtgactttctcaataatctcttcccacgagtagcctactactctcattttttccagcgtagtagccagatcaaagactggaccattcgtacgattgcggatataaatatctgtactgatcgagttggctttgagacctgcttttaaggcagtttcagcaacgtggaaattaaagctgtctgttccatgaccgatatcaaagacaacgccttttttatacgcatcccaaacaaagtctttgatttgatccgtggcttggtctaaaatgccgttcggttttccattaaaacaatgggtcaatacgtcgcctttttccattcttgtcaatacttcttctaattcaggaggcgccgaaccaatatgaaccatcaatggcaagtcattgttttctgattggatttttttggctaactctagtggcgtgatgccattctcgccgacaactgttttgctcattcttgccttgatccctacaataaattccggaagctctgctaatgcagctctgactagatcttcttggatttttgtcaggtcagcaagttcatcttgttccacgatcccccatttagaaatgttcattagtgcgtacacattggttttgaccgatttcgtcagttgataaaaatcgcgaatattttctgcgcccgtagtccctgcatcaataaccgttgttactcccttttggacccctatttgatccggataatcataataaagattcatcttttcataacagtgaacgtggtcatcgatccaaccggcagagagataggaattgccggatagatcaatcacttctcgtgctggctcattgatttcggcagcaactgctttgattacgcctttttccaacgcaacttccactttcctgccgtcgattaatttgccatttttgattaaagtatcaaacatttcattgccttctttctattgaattaccgctgggaagatcgcacctaagatcattgcgcctagaatagcaccaccggcaattggttttttccaagcataaaaagccaacgcgcctaatgtcgccccaataccaatgggaatagaggccgcacaagcactcaaaatgatcaatgggcccaaaaatcggccggaggaattgccggcgcccatcatgacatccgcaccaaaagttgaatttgactgattgatggtgaatttgcggatcaacacgataatgccgccaacgatcagacccaagaccaacccagtcaataacgagagggcaaaattatcgattggtgctgttatcttcatgcttaggagaatggctggaacgccaatcccgatcccagtcaaaatcgaaccgcctaagtccaagatccctaccaaagagccttctaagatccgagcaaataagaaactcgccccaaaagctgccgcagccccataggaaccgccatccaagccggcttttagcatcgcaacgatcgaaacttcattgaatgcaccgacgccatacacgacatacatatgggttcctgagaatacagccgctgacatgattcctacgatcaatgggaaagaccagtctgcaaaccaaaaactcttttgccgttttgcttctactgcttttacctgttcttctgtctccatgatttccctcctatttcacactaaagatgttgtgcaagttatcaagccaatgaggtacttgaagttggaaactcttgatcatttccatatcaaatccacggaaaaatccgctgaaaacaaagagtaaaacaatcgcaatcatcatactcttcgtgacccgattccaaccactctcatcgacgcctttaccgattaagattcctagaacaacgccaggaaccgcattgcccatgatcagttgcgcaatcccgccaaaaagcgtcccccagaaacctgttcgtttccctgcatctaaagccgccaaccagaagatcactggcatcacggtattgatcagaatcgtcgctgccggtaccaacacggaaacagcggttacttgtaacgcctctggaatcgctgcagctgtcgtattcaagaaagcgactactaacgcgccaataacagcgccaatgatccccatttttttcggatcatgcattgtctggctgacatctttgtttttggctaagagagccgcagctgcccagttaggcacgatgcggtgggtcacatcttgcgtgaaagctccagcgccaactgaagaagcccaagcattaaagaaaaaacctaatccaaaggaaaaatgggaggcagcatcccccatgcaggcattcatctcccctaatgttctaaaagctcctaatccttgcgtactgggtgcatgaaacatacgagctgctccaacagatgcagagaaaccgagtaagcccccgatgatgatcgatttagttaaaataatgacaaaatccacgttattccctcctccttatgattcaaatcaaacttttttcgttacaaacggtaaaacaatcccattggggtcttctgttaggtgttgagtgaatggtacgtctgccaaacgtatttctgtcacagttaccgtgacagaaagttcgacttcataattcactcgttgccggggaaaaaagaagaatagaaagcgttctgtgtatttgttttcgaccgccttcaacacctccacattgattggttcgatgcgcaataatactttcgccgatgccattagtttgttttggatctctgcgagtgctgatgcaaaggcatgttgcttagtttctcctttaccggagacgatgactttttgctgagttgtcttttgaacgctcatctcgtatgccctctttctattttccgtgctttttgataaattcttccgtcaaccgtttccctaattcctcttgatccataaaaccgaaacctagcacggttttcccatctttgatggcggtgatcccttcttcaatcgaacgcatcccatgacgttctggatacccatatttatttgcggctgttaaggctccagccccaccgctcccgcaaaaagaaattcccatatcggcattctcttgttgcatgacatcacctaaacgcatatctgcgcccattcccggaacaacaactgccttgccgccagctgcttctacacctttagctacgttttgtccttttcccatacgatctgcaataactactgtaatcatgattgtttcctcccaaatattaattattttttgctgtttcaaaatgaatcgataaaacatacatctcatcttcacctaaatcaccaatcgttcgaacgacctcgtcggaaatcgcaatggcttctttggatacttctcggaacaattcccgatcaacagcgggaatcttttctcctttttgagagcgtttcagcatctcattcaagtgattgatcagaatcgtccactgaagttcagtaggttcaatggcatattccgcaagtcgctcttcgactaaagcaatcacttgttttaatttttcctggttttgactttcctcgatcatagttatcgcttctgctgacagtttcactagcttgacgctccttcttttatatatgaaaataatgcgctgatttctgatttgttgatgcctaaattattttcagcaaaaattgcttcaatttctcctaccaacgcttctcggttcaaaatgatttggtcgacttggctgccttctgctaaatattgctgatcaaatgtgatgcgatggaccatcaagaaaacatgaagcaaaaaggcttctcggtattcttggatcaattcagactctaatgtgacaagtaactgttcatagatcgtatatgcctttaaaatcagttccttgctgaagtcttccagagtccccttattgataggtgcttcattgagaactaattggtgccgcctatcctgacttgttgaagcgaggatttttttgatcatctgctggatgttttgcagatcctgctcagtcggcagtggatggactttgatgaaaggccgatcaatgccattgatcggaaaaatactaatgactagatccggatccttcgcggcaatcacctcttgtgcatttaagactgaagcaaaagccacaatagtaatattgttcaattcttcgttgatcttttgcttaattaaactcgtcacacctaaacccgttgaacaaacgtaaaccgctcgaacacttcgcaagtcttcttctctttcgtaggaaaccagaaagtgcaacgcaatgtaggcaacaaaagaatcattgatcaagagtttctcgtttatttcttggagtgctgcttgattgatagcagcaaacaattcaggatatttctgtttgatgtcctctttaaacggattgtactcattgacaaaatttttccttcttgagagacgcatagacaaatgggcgtagagattcgtcaataattgagggtcttgataaaacggaaaattgattttcttgcttaccttataaattatattctctaccaatttcatgacatcttgctgatggatcgtatcaaaggtatcactataaatatagtcatactcatcttcaaacaagggcaattgatagtaatcaaacacctgctgcatcacacgatacgaaagatcatgtttgtctatttcgtgttcccggatcaattggtaccgtccaatcgtggattctttgcgcaagcgaacagtggcaatcgctacacggatcaggatatttagtagttccgcataatttagtttttccagattttcagattctagtaagtacctcatccgaatgatgacttgattaaagacctcctgcaacggtgttgccttcgcagaatacatttcgaagcattccgtttctctgccatttagcaataaagccattaatttataaatgtcatagtctgtaaactctttttgcaaaatctcctcgatcgttaatcgtactaggcgttccttgccagtgatccaaaatccctttcgtgtctggcgattcagaactaagccttctttgagataatggtattccaactcatccaaatcattcatgatcgtatctttacttacttctagcgcattggccagctttagagccgtgatcgcttccttggtaacaagaagcatgattaacaggcgattgatccgtaagccttgatcggcaaacagctccagacgattgacatccatcaattcgctttttagtttgattcgatcagaatcactcacacttagccaaataccctggctccgtttgctgtgcagttcttgattccgctcaatcaaccaatcacggatatcctccagatcatatttgatcgttcgtacactgacactttctttttcagctaactgtttgatcgttaccggttctgtcatttctaacaagtaaatcaaaagttggctttctcttttggtaagctgctgcatcgttctcgctccttacaccgctaaatataagcgttttcttaactagtcacaatatgaaatgtttgcacttaacttagtgcaaatgatcgtaatttaacaactcatcaacttattcacaagcttatcccccctcaaaaccgcaacgtggacccattaattattgcactaagtcgtccctttacaacatctcgatgccattttttctgctttttttattttatgacactaatccaactgacagatacccttcacctcaatgtatcagaaatcgattccccgcatgacatcattgaacagcaaaaaacactttccaacttttggaaagtgccaggaaataggatatgaacgtgttcgttttctcgactgattgttatttaatcaggtgattatgcatcaatgaaaccgttagacatatccatcttgattaactttgaacagctatttattgaatcaggagaagaaacagttcaagatcaatacacttgagaaccaatgaaaactcactaatgctatgccatttgtcattaaaactacttccatttgtactcgcctacttcatttcaaactctttgccgaattttattagatacattttttctaaagtgtcctctaacaaatacaacttcctaggggagataaatgcattcttccagtcccaattcaccaaatcatactttccaatgtcagccatcgctcttacttcttcaatcgataagttcaattcttttcttagttcatcgattttttggatttgtttttttcttctgagagccgttggtacgtttatcgaagaaatgaccaccataaaccctaaaaaagaggtccattcataataaaagtcaaataccttacatacaaataacagaaacaagcctaacaagaaaaaaataatcgaatacaaccaatcgatcttttcattagctaccatctttttcacgttgatagcctccctcctaattaccttcaagacaaacaataaaaaaagaaagcaactcgcttgatttcagccgctcccagctatattttactatggttctgattgactgttcgttaaatatttttcactattcttctatttttttcaaccttaaccgcaacacaagatacatcatacctccaaaaaagcaacctccgagaatggaagcaatgatcctgtctggtgaaacgatgtacggaaggaaatcttcttcatccaacatcatactaagtactccattcaataagtgaatcgcaattgcaaagtagatacctagtccaattcctttaagaatcgtcttcttcttttcttttgccatctctttggcttctacttcgttttctgtcaattttaagcgtgccgtggcaaacagaacataaccgcaaacgataaagactgtaaagaatatattacagccaataaaaatccataacgccagctctggtttcttagatgcaaaaaccgttaccagtaaattagcaaccagcgtatacccaaacatcagcataaacgcattattgccaatatgttctacttggctttttttgtattcatctaagacaccagaaataccataaaaccgcttgattatttttactgccaatccttctttagccttcatcactttcaacctcccaaaacaaagaatttaaatccgtttgcagtactttagcaagcttaatacataaatcaagagaaggattatacttattattttcaatcaaattgatcgtttgtcttgccaccccaatctctttagctaaagcattctgagataaattcatcttctgtcgaaattctcggactctattcattcttttctcctatttagtcatatatatgtgacacaagcgtactacttatctctttttctgtcaaatatatatgacatattaccaagctagtgtaaactcccagcaatcgatctcacaagctttgtagagagtataaaatttataatccatatcagcaaatctaggctagaagtacgtaaaaaagacccttccaatggaacagaccatcattacctaagataactattctagtagaatggaataagctttgcatgttccacattctgtaaccagcatctttcgttgaggagacgatacgctaaaaacttctttcttaatcctctcatcatagaactcttcttttttctcgaatcactttttgctatactaattgaacatatcgaaatttttattgtttatggaggaaccatgcaaaaatttattggaaacaaagctttttacaggactgttttaacgatcgccattccgatcatgatccaaaatgccatcactaattttgtcggtttattagacaatttaatggtaggacaaatcggaacggcccaaatgtctggcgtggcgatcgttaaccaactaattttcgtttttaacttaagtatctttggcattgtttctgccggtagtatttttggtacccaattttatgggaaaaaggattatcaagggatgcgagatgcctttcgtttcaagctagcgggcaatcttttgatttgtttgttggcgatggggctgctgtttttttgccaagattttttgattcgcttatatttacacggtaccggtgacagtgcagaactgacacttgctttgacgtctgccaaagaatttctagtcattcttttgtttagtctgccgttttttgctatttctcaagcttatgccagttctttacgcgaaatgggcaaaaccatggtaccgatgtttgccagcagtatcgctgtcgtcacgaacacagcattgaatttcttattgatttttggtttgtttttcttccccactttaggggtgcgaggtgccgcgatctccacattgattgcccgcatcgtcgaatgtgctatcacgatgtattgggtacatcgccatgaggaagagaatccgtttgccattcgggtctaccatcaattccatgtccctttgcatttggtgaaacagattctgcgtaaaggatcgccattgatggcaaatgaaatcctttgggcgatcgggcagacaatgattattcaagcttattctgttcgaggactatcagtgattgcttccttgaacatctcatccaccgtctccaatttgttcaatattgtctatatggcccttggcggtgccgttgcggtcatggtagggcaacttcttggagccgctaaatttgaagaagccaaagacagcgcccggaagctgcttttcttttccgtcatgagttgtcttgtacttggtcttttgatgatcctagtcgcaccattctttccagaaatttatcaaaccgaacccgaagtcaaacatctggcgagtcaattcatcaaagtcgccgcactgtgtatgcctatgtacgcctttaatcatgccagctattttattttacgttcaggtgggcaaaccttgatcaccttcttatttgacagtgtctttacctgggtgatcgtcttgcctctagcctttgtattaagcactcacaccagtctttcgattgtcttagtctacttgttctgccaactagcagagctgatcaagagtgggattgggtatcgtttgattcgatccgatctttgggtgaagaatattgtgcattgaggaaaagtttcaacataggggatgaaaaagatggatagtctggtggaaatgagtgattttttatcctaaaaataaataagacattcctaaaaccgattgtgattttgggaacgtcttatttattaagattatatttattcttttgaccattgaaaatatagacatttcatacaaaaactgttttcaaaaaatggtagctttactaaaaatgactccgcaaaatgatcatagtaattttttgctattattgaaataatttttttccagtccaacttgaaatttcgtaactttgtaaagtttttggaatcttactgtaattcaaataagtagcattttcgtaccaaccatctgccactacaataaagtttgcttgtgccccattcatagtgcccgataatgccccttgggtaaataccgtatgtcctccaatacttccgttaggtttatagtaaaaataagtaaatgctactggataactctgtgcaattttcgtttgatatccgaaaacgaaggagacacttttctctgatatgttaaactaacacttttatcttttgcgtattttactagtgctggtccaatttggtcaggttgtgtccctccataagagattccattattggttgaagatacggtagttcctgaatagttccacaatgaattgtatgccacctttaattccgaatcatttccagaattaaagaatctataggaagaacttatagttgctaatgcatgtactgcacaagcgtatttcccagtggctttttcagatctactctgggatagcgcattaaacattgctaaataatgtgcacttgtcaagtgtaaattacttggataattactaaataccgcgcttgcatggtcatactttgtagaacgagaattatatctagaaaagtgttctatttccatttcagcaacaggctgtacttcttctacatacttttcaaattcatttagtgaaaagttctcaccgttggtactgatgactgaatctttgtcttctacaactaaattatattcagtgggaaaagtctcaattaaataagattcctcagtattatcaactttcatttgtgatttatctgctaaaaatcatataaactttttgatccaagttctatagaaaattgagcaatataagtaccttccattcttaaatcaattataacgtaaccgtgtgtcacaccctctttaataaaatctacactataagaaataattttttcttctgtatcataaataggaattatagaagaaacaaccaaatcttcagttcctttaaattcttttgcaaagtttaaagctaaattggctaagctttcatcagttatttcaacagcagactgttcagaataattttcactgatgtctgcttctgaaatggaaacttcttttgcattagtactcttctctgtatatagaaacacaaaacaacttgttaccattacccataaaattctactgattttcttcatttttaactactctctttgtttgccaaccagcgcaaccatagaacacaatgtattattcattccacttaaaaccatattctatgaccaacattttttcacttcatttacctagcatttacaaattttatgacagtttaaaacattcagtagagcttaattgcttcgagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcaagaccnnntactgctttctccaaatggacacggaataattcattcaaatcgcctttgttcgctagagtctttagaatttctgtagtaaaatcgttcatagggaagtcctctcttctgtgaatgtgttgtggtagctctattctacagaagggacttccttttttctatttacacaaaatattttacactctcggaggtgatgtacataggatttaaagttgacactcttgtgtacaaacattagaataaacttatgtgggtttccacatagcagtaggcaacttgataatttattttaatttgtttatcaaaactacaaaatattgtaaaagatagtatggaggtggattcattggaactactttacattctcctcgctatcatcggtttaattgtcggtcttggattaggagtttttgtgaccaaatctcgtcacgaaaaagagatcaatggcgcgcaaaattctgcaactggaattatcgaaagcgctaaaaaagaagcagaaactctaaaaaaagaagcattgttagaagctaaggaagaaaatcagcgttatcggtcagagattgaaagtgagttgaaagaaagcaaacttgatttaaaatcacaagaaaatcgcttgctccaaagagaacaagtacttgatcgcaaagatgattctttggaaaaacgagagcactcactggaagaaaaagaaaacagacttagtgagaaacaacaattaattgacgagcgagaaaaagaagtagaaaaactaatcgatgggcaacagcaagaattagagcgtattgcggctttgtctagagaggaagccaaagagttgatcatgaaatcaacggaagaagaattgaatcatgaattaacgattatggtaaaagaatcagagcaacgtgcaaaagaagaagcagatcgtaaagcgaaaaacttattgtcattagcaattcaacgttgtgctgcagatcaagtatcagaaacaacagtatctgtcgtatcattaccaaatgacgagatgaaaggtcgaatcattggacgagaaggacgcaatattcggacattggaaacattgaccggtattgatctgattatcgatgacacaccagaagcagttgtactatcaggattcgatccaatccgtcgagagattgcacgaatgacattagagaaactgatccaagatggacggatccatcctgcacgtattgaagagatggttgagaaatcccgcaaagaaatggatgaacacatccgtgaatatggggaacaagcagcctttgaagtcggtgcacataccctacatcctgatttgatcaagatattgggacgtttacgctttagaaccagttatggacaaaacgtattgaatcactcaattgaagtggcaaaactttcgggtgttctagctgctgaattaggtgaggacattcagttagcaaaacgtgctggactgctgcatgatattgggaaagcacttgatcatgaaattgaaggctcacatgttgagattggtgctgaacttgctgccaaatataaagaaaatcctgtagtcattaacgcaattgcatcccaccatggagacgtagaagctacttcagttatctctgtgctggtagctgcagcagatgctttatccgctgctagaccaggtgcacgtagcgaatcgttggaaaactatatccgtcgtttacaaaacttagaaaatattgcgaatggcttcaaaggtgtagattcaagttttgctgtacaagcaggacgagaagtacgagttatggttaagccagaagagatctccgatttagatgcggttcgtctagtacgtgatatccgcaaaaaaattgaagatgatcttgattatccaggacatatcaaagtaacggttattcgtgaaacgcgagcaactgattacgctaaatagcataaaaaagaaccttggcttttaaagccaaggttcttttttatcaaatagtttagccctcgttagcaggattaaaattaatcaaagccgcctagtacttaagagaggttagatttttcttctgcgcgcaaagtctacaaatcgaaatttatctaagcgatgtatcgattcagtgtattcaaaacagcgtgtgtcttcaagataaaccaaactacgtacagtaacaacatgttgatcatcaggatgaaggtccattaaatctcttaattctttattgactggatccacggtaatttctttttgtgcataggcaatttcaagtccaagatcattttcaaagtaatcatagatcgagtcttgtgctcgacgttcaggcaattcttcaataatcgaagcatctaaataatctttatctagaatgacaacttcaccatcaatctttctttgacgtaccaatttccaagcttcagaagcaactggccaatcagtaataccatgtaattttggtgaaacggcgatcttacgaatttcaactacttttgtttcactaggaatacgttgagtatcttgtaattctttaaaactagttagaccagaaataggaaagtcaaaacgattcagatctaaaacgattgaaccttttccttgttttttttgaatgtagccagcattttttaaaagattcaaggcttttcgaaccgtttcacgagaaacactgtacattttgattaattggttctcactaggtaaaagagagtgtggcgggtattcgtttgacagtatcttttgttcaagatccaaaaatatctctttgaatttattcatgggattgcctcctcttgcctattatagcgagggcatttttgaaaagcaatcggctatttggccaataattcatcaattgaaagatccgtcagtttttcgacgattgtgtcagctccatgcagttcttcaccagaatagacaccaactgcatacatgccagctgccttaatgccatcaatacctgcttgggcatcttcaaaaccaactgcatcactaggtttaatgttcagcccttttgcagcttggataaagatttctggatctggtttacctttagaaagtgtggctgggtcaacgattacatcaaaatcctgcatgacacccaatttatctaaaataaatggcgcatttttagatgccgatgcgatagcacaaggaatccccttgtgttttgcttcttctagaaaagttttgacacccggaagaaggtcatccggagtcagactttgaagtaattgaacatagtgagtgttttttttgcttgctaaagcatctttttcttctgaactataagcatcatttttatttcctaatgttaaaatacgctctaaggaatccatacgactaatcccttttagttgttcgttgaattttaagtcgatttcaataccgatttcagcggctagttctttccatgcgatatagtgatatttggctgtgtctgtaatcacaccatctaaatcaaaaacaaacccttttttcattatgttactctcctttaatagttgatagattgttctttattggcttttaattcatgagtagcaccagaaagaatgatcgttgtattttggtcagctacaactgtcaatgtttcatgtgtaacattaaagtgataattaatacctctgacttgaatattaaattgaatattttgccattgcttaggcagatttggatcaatacgcatcacatcttcccgaaaatcgattcccgcaaatgtcgttagcggaatatagagagttgccgccattacacccgcatgaattccttcggcagtggttcctccttgaatatcgcggtaatctgaatagagagcctcttgatataaagaccaagcgagatcttgctggtcaaccattgctgccaattgagcatgtacaactcgagagagtgtagagccatgagaagttcttgccaaataataatgcaagtttttttctacataatcttcgggtaagcggtaagtaagatcatctaaaatttgatgcacttgcgctgttgaaaaattgtaaaaaatcattaggctgtcagcttgtttggcaactttgtatgcatcggcgctttttccttcagcatttaaaatacgatccatacgataaatgttcccatatttttctctataatgatcccagtctaagtcttttaaatcaaaatagccttcaaattgtgcaataattccttcgggattaatttctaaacataaatttttacgaatatcggtcatttgtgagaaattgtcctctgaaagctgcactttagctgctacactttgaaagatttctggtgaaagttggttgcgtaatttttccacttcttcaaacaaccacactaccatcatattagtatatgcattatttttcaacccacctttttgactgttgggatagctttcatgaaattcatccggtcccatgacaccttcgattgagtaacggcctgtgagagaatccaaagtagcagcactctgccaaaaatgagcaatttctaaaattaattctaaaccgtattgctccataaaagatcggtcacgaacgttatgccagtactgccatacattataggcaatcgctaaagaaacgtgacgttgcaatcggctatggtcttctttccactcaccactgataggattcaaatgaagttcttgtgactgttctgttccatctaaaccagattgccatggaaacattgctccttggtatccggcttctttggctgctttcttggctgccgttaagcgctgatagcggtaaagtaagatctctctggcggttttaggaaaatgaagaatataaaaaggtaagatgaataattcatcccaaaaaatatgaccacggtaagcctcaccatggagaccacgggctgtgatactagcatcaagagattgctcataggcgttgggtgctgctgacactaatagatggtatgtgtgaagattcagcattttttgtgacatgagatccccatcaatggtaatggctgcattctcccatagtttgcgccaagcttctttggattcagcatacatttctttaaaccgtggtagtgaaagaagtgccagcttgctagtagttgtttgttctcccatttgatatttagcaacagtaactgatttttctaaagtataagttctatttttctccacagaaattgttaatttttgaattactttttctgccgttttttctgattttaatgtttcaagagaaaagtcatcagaaaataattgtgatgcttggcaaaccgtaatgtcagactgatttgtacgggcaatgagtagagctttgctcttaaaatactccgttgtttgaatggtcaagtgcttgtttgtcaagcttcgatagcgtgcgacattataattgtagaccgaaccatctgcttcacttatcacgtcgatttctccggtaaaattaagtggagtaaagcggtaaaggatggagtagtgatgactatttcccatattagcaattttttgtgtttcaattcttaattgcttttttgtgtgtgtttcgatttcagcgaaggaggtaaataatccagtttttaaatttaattgacgcttaaaagataaaagtgtattttgtgcgatatcgattttttcgttatcaatgactaaataaattttttgcagatttggtgcattgacgaagtcctcatttgtaatggtacgatcagacacctctgactccgccgtattatagagacttgctaaataaatcccaggataattggcatcggaaatctccatttctggtgtagtaccacgcaaccctataaagccatttcctactgttaatagtgattcaacggagtactcatctttgccaggagtatagccataatattctaattgccaaggaatctccaaacgcttctcttcaaagctttcttcagttccacatacaaacgctcgatttaatttttcggttaaccattgatctaatgaaaaggttccttcttcgttagtaaagacgaatgagtcggaaaggattcctccctcttgattcttttccaattgtttctttaatgctgctattcgttcattggtggtccctgtaaacgtgaatatagcacccatgtggtcggccaatagccattgatcattagtgatctcaattttgttcacagtattctctcctttctacttgtctatacatgcaaaatgattataaccgatattgtaagctttttcaatttaataaggctgtttttttaaattattgtgtaaagttaaatgaaagtgatttgttttttttatttgctcaaagtttatttttttgaatgaaaatccttttgtaccaacaaaaataaagcatgttctgaatgattatttttcacaaatgtctttagtgaaaaaaatatagaatgaaacgcttgcaatattgtaaatataaagttatgattagcatgaaataaaaacatatatatacaagtttaaatggaaggggtttattattatggggaagtatcgggatgatgctgagaaattgctggagtatgtaggcggtaaagaaaatattgcagctgtgactcactgtgcgacgcggatgcgatttgtactgaatgatcagtcgaaagcaaacgagaaagccattgaagatattccaagtgttaaagggatgtttacaaatgctgggcagtttcaagtgattatcggaaatgatgttccaacgttttacaatgattttacagcggtatctgggattgaaggagtttctaaagaacaaagtaaagcgattgcaaaaaagaatcaaaatccgtttcaacgggctattgcagttttggcagagatttttacaccaattataccagctattattgttggaggacttattctggggttccgtaatgttttggaaggaattgattttggtagtggaacaattgtttcccaatctgtattttggagtggagttaatgatttcttatggctacctggggaagcaattttccattttcttccagtaggtatcacatggagtattactcgtaagatgggaacaactcaaattcttggtattattttagggattacattagtctctccacagttgttaaatgcttattctgttgctagtacagcagctgctgatattccattttgggattttggatttgcacaaattgataaaattggttaccaagcacaagttataccagcgatgttggctggttttatgttagcatatttagaaatcttttttaggaagcatataccagaagcgatttcaatgatttttgttccgttattctctttattaccaacaattttagctgcacatgttgttttaggaccgattggctggtggttaggagacattatttctaacgttgttaatacaggcttgacttcttccgtcagctggttgtttagtctgatttttggagccctgtatgcaccattagttattactggacttcatcatatgacaaatgcaatcgatatgcagttgatttcatcatttggtacgacaaatttatggccgatgattgcgctatctaatattgcacaaggttctgctgtattagcgattgtatttttacatcgagggaatgaaaaagaagaacaggtttcaattccagcaacaatctcttgttacttgggagtgacagaacctgcaatgtttgggatcaacttaaaatatgtttatccatttgtagctgcaatgattggttcaggtattgcaagtatgtttaataatttaatgggtgtgcgagcaaatgcaataggagtcggtggattacctggtattttagccatcaacgcaacagaaggcggaggtttgttagcttttgggatggcaatgctgattgcaatagttgtaccgtttattttaaccatagtttttcgccgtcaaggaatctttaataaaattgattcagtcaatagtgttgaagacaatgcgtatgcagaaggactggcaacagcaggtgcaagtgctggtgtagcaaacactccatctcaaactatttcaaaagagactactgtaactgaggaaatgctttatgcaccggcagatggtcaaatcattgcaatcggtgaagtggaagaccctgttttttcacaaaaaatgatgggtgatggctatgcagttcgtccaagtaacggaaaaatctatgctcctgttgcagggacggtttcaagtatttttgaaacaaaacatgcaattggaattttgactcctggtggggcagaggtcttagttcatatgggattagataccgttgaattaaaaggcgcaccattcactgtcaaagtgtcggaaggtgatgctgtcacagtagatacattgattgctgagatggatctagaagctgttaccaaagctggaaagaaaacagatgttgttacggttcttacgaacgctgaaaagatcaatcagctgacaatcaacaaaaccggcagtgtacacgcgcatgatcgagtaggggctgctgaagtccgctaaataaaaaagagtaggctcatgaaaggaagctatcattccattcatgagccgtatttttttgttttatttttcttaaagggttattttgtttggcgtacacgttctttataaaagtagcgcaaagttagaaatacgactagcaatactagcacccataggaagaataaagcgatttgtgaccctaaaattgttccggaaatataatcgggacttactttttgagcaaggtcgatcattgtcgcaactaaagctgttgcgacagcgccagaaaattgttgcagtgtgttgaagacggcatttccatcggcggccaaatgttggtcaattttacttaaccccatagtcatcatattgctatacgaacaaccgattccgatcatataaaagacatgggcagcaataaacgcccacaaaaacgtcaggtgcaatagcaaggccaacgctaaccagccaaaagtaatcaatacaagaccaatcataatcggttttttaggtccgatgctatccaacatacggcctgaaagaggagctagaacagcacctacaatcgcaccaggcaacataaccaatccagcagtgaatgcgtcctgaccaaggactatttgaacaaagtttggcaagacaaatgagattccaagtaaaagaaactgacagacaagaaatccgaataagaataatcggaaagaacgatttttgaatacagataagcgaatcaaaggctcagattgcaaggaacgtttatagaaaagagctgcacctaaaataccaagtgctaatggaaatatgctcgtaagagaaccaatttggtttaagaaaagcaaaaagccactaaacataaaagtgatacccaaaacactccacaaatccagacgaccagttttttcaattgcaattttaggtattgaataaagacctaaaaccaatgagaccaataagacgggtattaagaagaggaaaatgtagttccaattcaagagagaagtcaataaacctccgtaagtaggaccaatcgccggtgcaattgaagtagttaaatttccgattccaatcatagttcctcttttttccaaaggagagtacgtaaggatgatatgaaacatcaacggtaaagcaattcctgtacttgccccttgaagtaaacgaccaagtaataggatagcaaaggaaggggagaggaaatcaatcagtaatcctgctaaaaacaacccgttagcagccaaaaataatgttcgaatttgaaattgtttcaacagaaaagtagaaattggtacgatgatcgatatcaccagcaaatagattgttgtaacccattgcacatttgaagtagaaagattgaattgattaatcaaagtcggaaatgttacattcatagctgtttcgatcaataccccagcaaatgacataataccggttgctataatagcgcctaacaattttatttttttctccatattatcacctctaaaaaaattcataaaaaaagagccagtttctaaataaatagaaaccgcctctctctcgacaagcattactgcttgttatctgtacgatttaatctaaaagctattgtactgacttctttttgaagagtcaatagaaatgtttgaaaaataaaactgaattttatttgaaacttttcaaaaaaatccttacaccaaaatttttattttgttagaataatcaagtatgtaaaaaaaaaaggaagttttaaatgccgattaacaaaaaagaaagtttgatctatacgacatttatgtgtttttttatggtgtacttcatgagtgtctacaatttaatgtatgaggtgggaattactgcaatagcttttcaattggcttggaatgaactgccatttgctatatgtattgcgtttattttagattggtttattgtctcaggtcctgcgaaagcatttgctttccgttttattgaaaaagataccccagcttggaaaaagattggtctaatctcatcaatgatgattgctggcatggttttctttatgtcactttttggtgctgtaatgcatccgaatgtaaatcaaggactattaatgacatggttatctaatattggtaagaatgtagttgttgctttaccgttacaattattgattgccggaccaattgtacgacgattatttagaaaattatttcccataggtacggtacaagaaattcaatagaatttatacaaagggccacttctgaggttgaactcagaagtgactttttatctaaatatatttgttaaataacaaacaaaaaacaccataggatggtatggcgtttcttgtttaccctataaaataggatacaggatgtacttacataatagtatgcataggaagaaaagtatagttcaacaatttcattgctcggtgaaatcattgctttgaacatattttaatctgtaaaaaaattgaaaagttggtaccaaggacggtcagatacgatgtatgcttcaggagaaaaccctgatgatgcataccctaaaaaacaaatgaatagccctagaaaaatgaatgccccgcctatcattagtagcaaacgtttatttattttgatcatcttaccacctgcttttgaaagtttttgtataacgctttaggcaaatgaataaactgttgcgtccaacctaagatgggtttactaagcatataagtaaaaatcatacatactaaccctattccgaacatcgtgacgcctagacctagctgggtgatagaaaagtgaagaccttgagatagtagtaaagggcttaaaacaacacttgcaatgccgccaatcagtgaagttatgccaataacacttgtactgaatggaaggcaccaaataactatcaaaccactaagcatcaacaatagaacggttaacagtaagcttccccacagaggaaatcctagaaaaattatcactaataagaatggatgaaaacgccgaggaacttttacgacaatttcttcggcacctaatgcactttgagcaatactttgaggagtccctaatctggctacagcttcaacttcagagagtccctcttccatcaaatcttggatcatttcatcataataatcaataagatgatgaatctcacttggtttggtcttataggctaattcagctgctaaacttttaataaatgttatgcgatccatgtcagttgtctcctttaatataatgatgaattttttctaaatgaggccaatcaatagtcaaaaatttatggatactattttgaccatgagcagtgatttgataatattttctcagccggccattatgttcttttgaataagtcgaaacttttttatttgcctctaagcgtttcaagatagggtataaagttgattcagagattggcaatagaggagcaatatttttaacgatttcatatccataagagtctcctctttgtaaaaaagctaacacacagaattcgataatcccttttttcagttgactatccaatgactacaccaccttatacataatactatataaaacatagtatagttttgcaagtcgatttgtggaaatcagtctcaagacgtagtaacttccaggttgcgcctattttttttgcttccagtcatttttccttacttaaaattcatcgtacggtgaaaatattgattattttatattagattcttttggtaaagtattactaataaaaagttgttaggattttagacaaacgtatagttgttgtgttaggtaattgctgttggaaaagttgcttgataaaagacacacgatactcagtccagctacgaaagaagttagtaagagagtgtgtgtttatcaggaaaggagttaataatgagaaaacaaacaatcacaaagaaatatttaatcaataggttacgcagtcatttagaagaatatttgtatactcccatcactgttagaaaaattgcgaaatatgcaaagatttctacacaaccgatctatttgcaattttcgaatatgcaaaattataaacaggcaatgattgatgatgttttggcagagattcacgagctttctttgaaaaaggagatagaggatgatccattgtatacgttttggcttaactattatttgtttgccagccaaaataggaacttattttttgcgttatttttgaatgatatagggtgtggttcctatttaagagatcaatcattgtcattgtttatagagacaatggctgaatccgaagtatatcaaaaagcaaattgcgaagacattgaaaaattgcataatgaaagtttgattttcttttctggtctcgttcttacttatgtacggggagagaatatgcaagcaatagaagaatttttacaagatattaaagactatttttatcgtacactgattgatcctatgtatatttatcgagaaatattaccacaatcagtcatcgaagctggtttttaaaataacgataaactgttttttaatttttttcattacttgataggcttcttgctttataaaaattcttggctcattcattttcttgtaaacgaatagtatgggtttattgttggcaattttcaagaaatatgagaaggtagaattagcaaaaagtaaggtgttttatgactaaaaagaaacaagtgatggaggaatcttgatgggtcaaacagataattattcagataaaaaagctcaaatcgatcagcgaatctgttttttggaagagcatacttaccaaggaaacgaccttggcgtaacctttcaagagcatgcgataacctttaaatgctggacgccagaggctgatgcagtttcagtcattatttatcaaagcggagaggttaaagacaaggatcgtgtgatgacagttccaatgaagcaagaaaataattgttggaaggtcacagttacggatgaagtcaaagaaatgttctatacgtttgaaatccagcgaggacaagagaaggttgaagtggttgatctttatgcgaaagctgtcggtctcaatggggatcgtggggctatcgttgatttaaaagaaacggatcctgagggatggtcgcagacagaatgtgttggccaagatacgattacagacgcttacatttgggaattacatgtggaagatttcagtagttctaaaactagcggcatctcagaaaaaaatcgtggaaaatatctagcgtttactgaaaagaatacgcatcttgaaggagatgaaaggcagccaacagggctcgcctatttgaaagagcaggggattaactatgttcatctgttgccaatctttgattttgataatgacgagctgtctacagcctacaactggggatatgatcctaagaattataacgttccggaaggaaagtattcttcagacccgaaggatcccaaagcccgcattcgggaatgcaaacaaatgattcagtctctccatgaggaatctattggtgtagtaatggacgtcgtttttaatcatactgcagtcacagaatcttcttggtttaataagactgtgccaaactattactaccgtaaggatgaagaaggaaatttcgctgatggctctgcctgtggcaacgaaattgcctcagaacgtaaaatgatgcgcaagtttattattgattcaatcctttattgggctaaggagtacaaaattgatggatttcgttttgatttgatgggactgatcgatgtggagacgatgaatcaactgcgtgcaagcctggattcggaaggtttctctcatgttattctatacggagaaccatgggatgccggcagcaatcgtatcatccagccaaacatcccagcgaataaaagtaatgtctgggcactgtcagaaggcgttgcggtttttagcaatgatttaagagacagtatcaaaggtgatgtctttgaagaaacagacggagcttttattcaaggaatgaatggtcaaccgcaagtcaagcaaaccttttatgcggcaaatttggcaacggcgattcaaggaaatacgaaagttgctgaacaagaaggcgccgagcgctgggcaaaatctccccgccaagtgatcgcctatgcttcagtccatgataatttgaccttatgggacaaactggtggcaaccatgcaggcttcagcgaaggaaagaaattatgattttgatcctgagcttttagcccgcaacaaactagcagcagccattttgtttactagccaaggagcagtattgacccaagcaggcgaagagtttggccgtaccaaacaaggagacgaaaattctttccgttcaccgatagaaattaatcagctagactggaaacgcgcacaaacttttaatgagttgcggtcattttatcaaggtatgtggcagatccgtaaattctatcctccattgagagatgccacgattcgaacagctgaaagtattcagtttattgagagtaacaatgaaaatttccttgcatatattattccgaataatggttacaatgatacatggcaatcattagctgttttggtgaacagcagcaataaagacattttggtaaatagggaagaattcaagcaagagaaatggtggatcgttgcagataattttggagcaggtatagagccacgtggagagatcgtgaaggaaatcaacatcgctgccaaaagtcttttacttttagctaaatagttattttatttttaaaatttttaaattaagaagaaagttaaattgtattaaaatccatatttaatggattttaatacaaccattacgaatgtttataaagtgataggaataattttctgttatgagagaagtacaggtggaccataacatgaacagtttaaaagaaaccgattttatgatgacaatctgactgcttaatgctatagtaaaaacagaaaaaccaaagttggattgttactgactcgatcaggcaaaacctaaatgagaaaacgctctttgtagcggctcttatttaggttttttatttttttcgggtatttcttagaatgttaagcagcaaagttattgtttcagttacttgcaaacatatgactttgttaaaataaattaggcaaaggagaacgagcaaatggcaaaatttccagaaaatttcttatggggcggcgcgaccgcagcgaatcaattagaaggggcgttcgatcgcgatggcaaaggcttgtcagtggcggatgcaatgcctggtggcaaacagcgtttagcgattttaggcagtgatacgtttgattggacgatcgatgaggacaaatacacctatccaaatcatcgcgggatcgaccattatgaccgtttcaaagaagacattgcgttgtttgcggaaatgggcttcaagagctatcgtttttcaatcgcttggacacgtatttttccaaaaggtgatgaaacgacaccgaacgaagctgggttagcattttacgatgcgttgattgatgaatgtttgaaatacgggatcgagccagtggttacgatctcccactatgaaatgcccttgcatttagccaaagaatacggtggctggaaaaatcgagcattgatcgatttctatgagcgttttgcaaaagtcgttttggaacgtttccatagtaaagtcagatactggatgactttcaatgaaatcaattcagctttccatttctccgcattgagccaaggaatggtcaacagtacgggtgctagcgactttacaaacgtgatccaagcgtggcacaaccaatttgttgccagcagtaaagcagtaaaaattgggcatgaattgaatcctgagttacaaattggttgcatgatcatttatgcaacgacctatagcattgatgcaaacccagtcaaccaagtagcaacaatgacccataaccaagccttcaactactactgtgccgacgtgcaagtacgtgggaaatatccagcatttactgatcgcttgtataaagagcatggggtcaagaaggaagatcttgatattaccgaagaagatttagtattgattgctaagtataccgtcgattatattggatttagctattacatgtcttctgcagtggatatcacaacagaagaagctgatgaagtacaaggtaacttgttgggtggtgtccgcaatccattcttggaagcaagtgaatggggctggcaaatcgatccagaaggactgcgcattgcgttgaatgaattgtatgatcggtaccagaaaccattatttatcgtggaaaatggtttaggagctatcgatactattagtgaagatggcaaaatcgaagacgattaccgcattgattacttacgtcgtcatatcgaagcaatgggtgaagcgattgaagatggtgttgacctgatgggatatacaccatggggatgtattgacctcgttagcgcgtcaaccggagaaatgagcaaacgctatggctttatctacgtggactttgatgatgaaggcaatggcacaatggatcgatcaaagaaaaaatccttcgattggtataaacaagtgattgcttcaaatggagaagatttagcgtaagattaatactcgtttttttatagccgcacaacacggattatcgttgtgcggttattttgctgaaaaaatagattgtctgaatagagtaaaaaatctaaaaataatagataacacatcataaaaattttaatcagaaaaactttaataattgcacttggtaagcggaataaaactaaattttctaagaatggctgactctttctttccaactaaaaggggaccaacatatttttgatgatatggaaaattttgcaaatttagaagggcgttgtggttttcttctgaaatgtttcacgtgaagcatttttacagaagatagttacatcaaatgcaatattttcgaaaatagcgactctattttgtgaagcggatgagtttctcttagaacgtttggattaataaaaattatttcgagccgattaaagaagtaagagaacggagtaggaaaaattgtttcccctcatctattcgaataattggtctttaccatatgatggtgataagattaaaacatagaaatgtagagcattttgtttgtgaaaacgtttcaattttaaagaatggagagtaagcgattaaaaaataaaaatagtaggcaagttacttcttttttacttaagagaggagtatattcgtatttggaatttttctttatttagaatgattttaatgtatttttttagaaatagggggatgtaaaatggatattgtaacattagcacgaatccagttcgcgatgacgacgatttttcactttttctttgtaccgttttcgatcggaactggtgtcgttgttgcaatcatggagacactttatgtgatcaaaaaagatgaaaaatatcgccgaatgacaaagttctggggaaatatttttctattaagttttgtggtaggagtggtaactgggatcattcaagaatttcaatttggaatgaactggtctgattattctcgttttgttggggatatttttggtgctcctttggcgttagaagcattgctagccttctttttggaatcaactttcttagggttgtggattttcacatgggataaagtcagccctaaactgcatatgacgttcttttggttagttactattggctcgatgctctctgctttctggattttagctgccaatagttttatgcaacatccagttggatacacattgaacaatggtcgtgctgagatgactgacttcggagccctgctagctaacccacaagtctggtatgagttccttcatgttattactgcagcaattgccatgggaggaattctgattgcaggaatgtcagctttccaattgttgaaaaaagacaagaaagttgaccgtgattttttcaaaaaatcaatgcggatcggttttgcagtagctttgtttggttcaattacggtgttgatcgcaggtgacgaacaaatgaagtatttggttgaagaacaaccaatgaaatttgcagcaatggaaggtacgtatgaagataccggagatcctgcggcatggactgtagttgcatgggcaaatgaacgagaacacaaacgggtttttggtgttgagattccttatatgttgagtatccttgcatttaacgaaccatctggttcgattgacggaatgaacacagtgaatcaagatttgatcgaacgttacggagatcggaactattttcctccggtcaacacattgttttggagcttccggatcatggcaggtttcggtgcattgatgttgttggtttcttcattggggttattctttacgcgtaagaagaagccttcgctatttgagaaacgttggatgctttgggtagtggctataacattatttaccccattcattgcaaatacagcagggtggctgattacggaattgggtcgctatccatggacagtctatggtttatttacgattgaagatagtgtttcgccaaatgtatcggcaacttcgcttgttatctcaaatattgtttactttgttcttttctctggtttggcattaacaatggtttatttgattcggcgagagttaggacatggtcctgaaaacaaccagatggaaggaacgctgcacgaagcagaagaagatccatttgataaggaggcgtttgaaggatgaccggattgcaactaatgtggtatgtattgattggcattttgtttgccggcttcttctttttagaaggatttgactttggtgtggggatgtctgtccagacattgacccataatgaacaggaaaaagatcagatcgtgcatacgatcggaccagtgtgggacgggaatgaagtttggttgattaccgcaggtggcgcgatgtttgcttctttcccttactggtatgcctctttgttcagtggttattatttgattttgttattgatactagtcggattgattatacgcggtgtctcctttgagtttcgggcaaaaatgcctgaagaccgtaaaaatatgtggaattggacattaaccattggcagtacattggtgccttttatgttcggactcttgtttacaagtatggtccaaggcatgccaattgatgcagagggaaatatgtctgcgcacttcggtgactacgtcaatctcttctctgtagttggcgggattgccttaactttgctttgctacttacatggattgaattatattgcactaaaaactactggtccgatccgtgaccgtgcccgaaattatgcgagtgccttttatggtgtgctatattttggtttggtggcgtttgccgcgctactttatttcaaaacagatttctttgaaaaacattttgcttcgacgcttcttttgctgattgtgattgtggctttgacgctgatagcgaatatctctgtatttaaagggaaagaaatggtggcatttattgctagtggtttgaccatggtggcgctagtcggattgttgttctctggtttgttcccacgagtattgatcagctcaatcgaccctagttatgatttgttgattgcagaagcttcctctagtcactacacattgaagatcatgagttatttatcactgacaatcttgccgtttgttttggcttatacagcatggacctactatattttccgtaaacgaattagtcatactgagctgacggagggttattaatgatcgacaaacaaatcatagagcttcccggaatgaaacggttaatgggattgcttgcaggactttctttcctgcaagctctcttcatcattggacaagcctatggtcttgctagtgggatcactggattatgggaaggacaatcgttagaagagcagtggggctggattctactgttcttttgttcgtttttaggtcgccaggccattgtttattttcggacaaagaaattagacagctatagttaccagcaagctactgaattacgtaatcaactgctagaaaagatttttcgtgtaggaccacaaatcgttcagcaacaaggtaccggaaacattacaacgatggtattggaaggcattagtcaggtagaaaactatttacaacttattttggcaaaaattatgaacatgtcgatcattccttgggtgattttggctttagtattttacttggattggatctcaggtctggttttattgctggtttttccactgatcattatttttatgatcatcctaggctatgccgcccaaagtaaagctgaaaaacaataccgcacatttcaattattgtccaaccactttattgattcattacgtggaatcgacaccttgaaactttttgggatcagcaaaaaatatggaaaaagtatcttcgcttctagcgaacgttttcgtaaagcaacgatggggtcgttgagagtcggaattctttccacttttgcattggattttttcacaacattgtccatcgctgtggttgcggttttactggggctgcgtttgatcaatgaagaaatcttgttatttccagcactaacgattttgattttatctccggagtattttttaccaattcgcgatttttcaagtgattaccatgcgactttagatgggaaaaatgcaatgaccgctgtatctacgattttatctgagccagaagcagccattgatccagtaagtttacctcaatggcaagctgattcgcaactatcgattcattcgttatcttttgattatggagaaaagtctgttttgaaagatattgcattggaggtccaaggatttcaaaaaattgggatcattgggatgagtggctctggaaaatcaacgctgatcaataacttaagcggctttttgattccgaaagaaggcgaaattacttttgatggccaaaaaatgactgcattaagacagtcggattggcagcagcaactagtttatattccccaaaacccctatatctatcggatgactttgcgagaaaatgtggctttctatcagccaaatgctactgaagaacaagtgtggcaagcaatcgaagttgcaggtttaacgaaattagttcaagaattgccgcaaggaatcgatacaatgctaggtgaaggagaacgccatctaagcggtggacaggcgcaacgaattgcgttggctcgtgctttcttagaccagcatcgaaaaattttattatttgatgagccaactgcccatttagatattgaaacagaagtagaattgaaagaacggatgcttccgttgatggagaaccatctagtcttctttgcgacacatcgcttgcactggatggaagagatggatcaaatcctagtaatggatcaaggcagaattgttgagcgggggacattggcagaactgcaagcaaagaatggcgctttcgttgcgttagtcaatgggatgaggagggaacaacttgaataaaatcggtctctggcgttcgctaaaaacagatacctgggtcaaaccctttctttcaaagtacaaaaaggttcttgcagcagcgctgtttttaggatttatgacattcttttgcggaggcgcgttaatgtttaattctggctatctgattagccgctctgcctcaattccagagaatattttgttagtatacattccaatcgttctgacccgagcattcgggatcggccgaccagtttttcgttatgttgaacgactgacaagtcataattgggtgttgcgaatgacatcgaacctacgcctaaaactatacaatgttgtcgaaaaagatgccgttttctttaagcagacccatcgaactggcgatattttaggattattagcagaagatatcaaccatatccaaaacttatatctgcgaacgattttccctacggtgattgcttggttattgtatacttttctgattatcggattagggtacttttcgttaggatttgcattggtaatgttgctgttgttgggaataaatgtgtttgtgctgccgctctggtccgttgtgatcaatggcgctcgtcaagaaaagcaaaaacaaatgaagaatcaattatatacaacattgactgataatgtgctaggagtttctgactgggtattttcacagcgaggagcagaatacgtcgatgaacacaagcaattggcggcaaatctacgaagcgttgatgagaaaatcaatcgttttgatcgaaaaagagatttccttttacaagtgatcttcggggtgattacggttgcgttgattgtctggacaagtcagcgatttcctggcgagcacggtggcttagctaattggatagcagcatttgtcctttgtgtctttcctttggtagatgctttcgcaccattaccttcagcggcacaagaaaccaatatatacaaagattcgattgatcgttttaatgcattaccagaaaaagaggaacaaaaacggacagcatcagctataagtgcaccgttcaatttagaagtgaatcaggttagtttccattatccatctgaaaaagaggtactaaagaatcttagcttaacgattcctgcgcatcaaaaactggcaatattgggacgtagcggttctgggaaaagtacctttgcttctttgctcaggggagatttattgccgacccaaggtagtattaccttaaatggtgagccggtagcaagttttggtgaagatattagcgaatggattggagtcatcaaccagagtccttatttgttccatacaacgattttaaataatttgcggattggtaatgaagaagcgtcagaagaagaagtttgggacgtactgaaacgagtaggcttatcagagatggtgacagctctgccagaaggtttgcgaaccatggttgatgaagcagggttacgtttttccggcggtgaacgccatcggttggcattagcgcgaattcttttgaagaaaacaccgattattttattagacgagccaactgttgggctagatccaatcactgagcaagctgttttggaaacttttttcaatgagttggaagacaagacgattatttggatcacccaccacctgcaaggaatctcactgatggatcaggtcatttttattgaggatggagaattaacgatgagcggtacgcctgctgagttagctgtcgaaaaccaacactttcaacagttattagctattgatcaagggcgactgtaatcaaactgggacctttgccaagacaacaaaaaaatcggctagtgatcgacatgaatgtcggcttagtttttgaggagcattcgctcctcaaaacacttcactgtttacccgattggttcgtttattttcagaatagctttcagttgcggagggtagaataaagaatgatcaataatttcgttgcaaaagcagttgcgttagctcgcgaattttttctttgctaggggtgttcggcagcagttcgatgtcggctagtgctttttcggtataagaaacagcaaaatcggtggctttttcgacgccatgataacggcgcactaattcagcaacctctgtggcctcctcggtggtcaactcgctttttttggacagatagctctcaaatgcggcaggattttgttctttagcaaagagcagaggtaatgtatagacaccttgtgccaagtcttcaagaacgggttttttcaacgttccagaatctgctgtatagtccaaaatatcatcaaaaacttgaaaagcgatgccgatgtttcgtccgatctcaccagcccgttcttggttttctaagtcgagaccgccaaaatgagcaccttcgatgcaggccagccagaataattcggcagttttaccattgatgctttgtaagtaatcagcaattgattcatctatattgtagcgtgtgtgcatttgatctaattctcccagcaaaaggcgtttcattgcttgggcatttgtagccaaaaaatgagagccattcatgctctcgatcaataactcaaagaattgggtgaagagcaggtcacctgtgtaaacagcgatatctttgccatattttgcttggacagtgatgcgtccgcgacgcaacggcgaatcatcaatgatgtcatcgtgaatcaaggttgccatatgtaagatttctaatgaagcagcaattttggttaattgatcatttctttcatcaatgggttcgcctagatcagcgaataagaaaaataatgctggacgcagcatttttcctccagaataagtaaaatcaactaatacatcttgtatttctttgttacgaacagttacgcgttcttcaatgatcgaacagacagtttttagtctttgctcgatcgaaggataatcgatccaaaaattcaacatattaaaaccctttctaccagtcattcagcccttattctaacttaaagggagtctattgactagttaagtgcatttatcaaaaggagatgagtatttgacactcccagtatttctggagcttgtggaatttaaagcgaaaacagccagtgtcctcccattttttatcggaatttgttacagctggtataactacggctcaattcatttaggttatgtggtgttatactttattgctatgctgatcttcaacatggcagtagatattttagataattataacgattaccatcacgcaacagaagttcatgattacaaagaaaaaacaaatattatcggacgcgagcagctctcgcttccattcgtttttcgcttaatgatcggtatgatcgtcgtttcggcggtgatgggtatcgtattggcctatttcgtcggttggcccttgttttggatgggactttattgttacttgattggtatcttttactcatcaggtccgcggcctttatcgagtttaccgctaggtgagtttttttcaggatttacgatgggcttcatgatttcgttgatttgtgtatatttgaatacttatgaaacctttcaatggaatagcgcgaccttgggtggaatatttctaatcgcactacccaatacactgtggatcgctaacttgatgctggccaacaacatttgtgatttggaggaagatgaaaacaacaatcgttatacattggtgcattatttaggaaagagtcaaggattacggctatttgttcttttgaacattattgcatttgtagcgatcttgacagcagtggttctgcatttagcaccatggacgatgttgttgacgtttctcgtcttaccatttgtctggaaacagacaaaactatttatgcataaacaaatcaaacgcgaaacctttgtctgcgctgtaaagatccttgcggtcggagcatgtgcgcaggtcattagttttgcgatcggtttgattttataattttttgaaggaagaaaggaagtaataggaaatgaaggaagttgtcattttaggagcaggctacgcagggttgcgagcattgcatgtattacaaggatcaaaaggtgattttcatattacattagtagataagaatgactaccattatgaagcgacagatttgcatgaagtggctgctggaacgcagccaagagagcgaattagttacgatatcgctgatgtggtacgaccacaaaaaacaactttcctacaaaatgaagttgcaacgattgaccgtcaaagtcaacggatcatgtttacggatcaaacatctctttcctatgattatttgatcgtagcattaggatttgaatctgagtcatttgggatcccaggtgttaatgaaaacgcattggaaatggtagatgttgattcagcagaaactatttatcatcatttattgaaacaaatgaaagaatacaaaaaaacacaagatccagatttattgaaaatcgtcgtatgtggggcgggattcactggagtagaactcttaggttctttagtggaaaatcggaaggaatttgctgagatcgcaggtgtccaatcagaagaaatcaaactcttttgtgtagaagcagttacgcgattattaccgatgtttgatgaaaatctgtctgcctatggaatcaataacttggtaaaatggggtgttgaatttctaacaggaaaaccaatcaaagaaatcaagcctggagtagttgtttatcaaacggatgctgaaacgggtgctacagaagaattgtctgctaaaacgatcatttggacaacaggtgtcagtggaagccatgtcatggcagattcaaattatgcggctcgccgtggacgtgtgatggtcaaccaagatttaagtgatccagagcacagtaatgtttttgtagtaggggatgtttcagctgtgatggatcctgcaacaaatcgcccttatccaacgacagcacagattgctttgaaaatggggtatcaatctgccaaaaactgtctacacttgattaaaggtgaaaaaacggaagactttcattttgaatctttaggatctgtagcctctattgggaacacgcatgcctttggtttggtgggtaaaatgcctgtaaaaggttatccagcatcatttgtcaaaaaagccatcatggaccgctccctgttcctaactggtggggttaaagaagtgttagcaaaaggccgctttgatttttatcattgagtcgtgcgctattttttcaacttaacattaacagaagcaagaagagaacatgtaccgatggagatagtttaattataagtaaaatagacagagatgccgattcatgttgggtgtttctgtctatttactactatttcagtttttaacaccatagggcgtaaggcctttattgaatctctagataaatgatcaggttttgaagagaaaacagggtaagaaaaaacccccttttgtacctttattaaaaaaatgttaaaataaagagactatgtttgttgggaggcatgaaatgacgattcgtaaagaaagacgccgtttagaaaaacgattgaagcgttcattattagcaaaaaaagggttgacgatggctacaactgtggtagccggttcaacgattgcaccaaatttggttttagctgcagaaacagcgacttcagatgatgcaaaaaaccaagcagagatcacagaaaatcaagtatctggaggaaatagctccactgattcaactggagacagcattcaaagcagtgctgacgagacgatttcgacagaggaaacaacagaaccaactgttcctattgaagagcagcctgttacaacacctgaggaagcggcaacgccacaggaaactatcacggaagatacagcggtcgttgagacgccaattgttgctgcacctgcgttagcaagaacctcgatcttctcagcacgtgctgatacgagtggatttattgcgaaagcaagtggttatgcaacagaagtagctgccgctaatgatctctatgcatcagtgatgattgcacaagctatcctagaatccggctggggtacttcgactttgacgacccaagcgaacaatatgtttggaatcaaaggaagttataatgggcagtatgtcgaaatggcaacattggaagataatggttcgggcaattattatcaaattatagcgaagttccgcaaatatccatctttaagagaatctttccaagataatgcgtatgtcttacgaaataccagttttgctgccggtagctattattacagcggtgcttggaagagcaatacgagatcatatacagaagcaacggcatggctgcaaggacgctatgcgactgatacttcctatgccagcaaattgaacaatcttattgcaacgtataacttaactcaatacgatagcggcagttccgctgggaacggtgacatgaataatgttgagacccctgtaggagaaaacgcgattcaaaagcaaatgaaaacgactgcatctatgaatatccgttcagatgcgtctactacagcagcagttaccggctcacttactgcgaatacaacctttacggcagttgcggtcaaaacaggaacgagcgtcaatggcaatacaaattggtataaagtttctggcaaaggctgggtcagtggtgcgtatttaacagaagtaaattctggttcaacatcaggcaatgcaaatgataatactgtcaatactggaatcaaccaaaagatgaagacgactgcgacattgaatattcgttctacagcatcgacgagtggcagcatcgttggctcattgagtcaaggcagcactgtgacagcaacggcagtcaaaacaggaacgagcgtcaatggtaatacgaaatggtactatgtttctggcaaaggctgggtcagcggcgcgtatttaacagaagtaaattctggttcaacatcaggcaatacaaatgataatactgccaatactggaatcaaccaaaagatgaagacgactgcgacattgaatattcgttctacagcatcgacaaatggcagcatcgttggctcattgagccaaggcagcaccgtaacagtaacagccgtcaaaaatggtactagtgtcaatggcaatacgaaatggtactatgtttctggcaaaggctgggtcagcggcgcgtatttaacgagtgactctagctcatcgtcgaatacatcgaatacaggtgattcgatcaatcaaaagatgaaaacgaccgcgacattgaatattcgttctacagcatcgacaagtggcagcatcgttggttcattgagccaaggcagtaccgtgacagcaacagccgtcaaaaatggtactagtgttaatgggaataacaaatggtactatgtttctggcaaaggctgggtcagtggtgcctatcttacgaagaccgcgacaaatgcttcttcaagtaatagttctgccaataatagttcttcgactaaatatcataccgttaaatctggggacagtctgtggtctcttgcgcaaaagtatggtagtagtattgaccaaatcacttcatggaatcgcttgtccaataatatcatttatgttggtcaaaaattgatcgtgaaatagtgagacacctgatttcatgcaactcaaaagaaaatcaatcagcattacccgatacacattcgtgatatcgggtaatgcttttttgctggtttgttcgtaataaaaatcgctgaagatagatttatttttgaatggtcttttagaatcattctgtttacatctgtcaaagaatccaagcagattttggttccgtcccccctatggagtttcctattttttaggtaaaatagaaaacaaagaaaggagtggagagtatgaagacgattgtttatagtgggatgatgaacggattgacgattgatcgctcacgacgagatagtatctacaatatggtgaagcattggcattctgaatgcgaaatccaatattttatagaagggaaccgctattttttgattggagaaaaaacctataaaatccaacctggtacattggttatgattcaccccgactgtgtccacaatacattctcaggaaagtatatttatcatgatcgtgtactcgttctctatgaagccagcaaatttccaagaatcgctcaatccatgggaatagatctggagaccttttttttaaaacatcatggtatcattcagattccgccagcggatcgctcttacgtacaaacgctcttagcgaaaatcgcagatgaagtgatccacaaagaatacaattaccaggtaatggtcgaaacaaaattaatcgaactttttatttttattcagcggatcaagaacttcagggggctttctgatgaaccggcagaaagtttgggaaaacaaagcgagctagttaatcaaattgcagcctttattcgtcggaactatgcatcgattcattcattggaacaaatcgcttcgtctttttatctcgacaaatcctatttatgccgtatcttcaagcgtgcaacaggctacaccatcactgaatataccaacattcaacgaatccgtcagtctcagcgattactggaagatacagattgggatattgctgaaatagcgagaaaaagtggatacagcaacattacctactacaaccgtgtgttcaaaaaatatacagagacatcccctttgcaataccgcaagaaacaaattgcatacaaagaaagtctgcgagaaaaaaataatttctaaatagtcactcatctttgcacaggcatgaaaggaggattattttcctgttaaaaaagtcaatattgtacaagttcgcggatattacgtcacttttttgtgcaagttttgcttgtctattgctgagacattttttgtccgataaaatcagtaagcggatacataaatgaaaaattgtaaacgtgtgcattttatggaggaggaaataatcagatgaaaaagaagatattggttgccagtctttttagcactttagttctagcagcgtgtggatctcagcctgacactactggttctggcagcagtggttcaacaaaagatgcagaagcagtgacgattaagtttgcttggtggggagcggataatcgccatgatgcgatgcaagatgtggtggctctttttgaagaggaatatccgcatatcacggttaacacagagtatggtgcgtgggatggatggcaagaaaagacattgactcagctatccggtaaaactgaagcagacgtgatgcaagtgaattacaattggctcttttcattcgggaagggcaagaatatctttatggacttgaatgaggtcagtgactatttgacgctagacaattgggaaagttcttatttagaagcgatgcaagtgggtggtgaacaagccgcggttccccacggaatgaccggtcgggttcctttgatgaaccaagcactttatgaagccaatgggttggaactgccaacgacctatgatgatcttttggcagcgggagaagtcattgcgaaagggaatacgccaactggtgaagacaatcagtacgcatatctcaatgtgggagagttctcattagatctatttattgctcagatgctttacaactatacagggaagatcatgcagaccgctgggacagtcaactatagtgtggctgaagtgaaagaagtgcttgaaagatataaagaattggaagatgctggtgcactgccgacttttgagcaaacaagcccaatcgatacggaatcaaaccctcaatgggtagaaggcaatgcaggctctgtttatgagtgggcaaactcactggcgaaatggacaaactcatacaaaggcggcgacgggttagatgagttagttgtaggagatttcttgcaagtcgatgctgactctaaaccaagtatctatgtgaaaccaaattttggctacgcaatttcaaaaaattcgaaacatcctgaagcagcagccacttttattgagttcttgtttaccaatgagcaagcggtgaaggctgccggagattctttgggtatttcaagcaacacagtttgttacgatctgcaagtagcgaatcaactagtcgaaggtgctgtggctgaagggtacgccaaattggatgactatgaacaaacggtgttagatccatactttgaagacgaaaatgtgcggggagaaagatatacggtttacgaggcatttcggacaggaaagttcacgtcggaggaagctgcgaagcaattcattgagaaacagcaagcagcacttgataagtattaccaagaataggaagcaacaagaaggaatgcgagacttagctacgtcccgtacccttctttttccgaaataaaattggacatgagtgagaatgtctggaagtaacccattagtatctgggcgttcatttagaaggtaaaggagtcaaatgcgatgttgaaaaaaatgaaaagaacaaattgggtgatctactgcatgctcatgccatggatcattggcttcctagtctttaaagtttacccaatcattatttctttttactacagtttgttagaatatccgattttaggtgatccggagtttgtcggattacaaaattatctagagatttttacaaaagacgatacgtttactgcgagtttctttgcaacaatcaaatatgtgttgattggtaccccagcagttatcattgtctcttttgcagtagcagccatcttgaattttaagcttaagggagtcaatttctttcgtaccgcttattatattccttctattttaggaggaaatgtagctgtttcaattttatggaccatgctttttgatgtcaacggacctgtgaatatggtgttgagtgtttttacactcggaaacgatgtcgccattaactggacaaaagatccaaagttcgcgatttttaccctgattattttaaaaacttggcaattcggttcgaccatgttgattttcttatcggcattgcaaggtgtttctaaaacagtttatgaagcggcagaaatggatggggcttcaaaaataagacaactgttcaatatcactgtaccgattattacccccgtaattttgttcaacgccgtaaatgtattagtcaaagcgtttcaagagtttaactccgcgtatttaatcactaaaggtggaccaaataagacgacttatttcttgaatctttatatttatgatcaagcctttcaaaatgggaattatggctatgcgagtgcactaacatggattttgttggtgatcatcggtatatttacggttattattttcaagtcatctgatcggtgggtattttataatgattaagggggctgaataatggaaatgagtaaatctcgaagacggatgaatgaaatcattcgttatggattattgattggtgtggggattatcttgatttatccgttgttttggatgattggttctgcgtttaaagagaaccgggacatttttggtagcttgagtattttcccgccaagtgaccgtgtggttacaacgaatttttccgatgcttggcagttgacgcgagaccattctatctggtttttctttgggaatacactgaaatttttgattccaaaaacgatttttacagttttatcttgtgtgattaccgcctatgtgattgcacgaaaatcgtttaaagggaaaaaatttgtctttggtgccgtgatcgttacattattgatgccagaactggcttttcgcattccactgtatctgttgtaccgtgaggtgggacttttggatagttttgccagcctttatgtagcggatatttttgctagttcttcgttttttgtatttatgatcattcaatttatgcgaacaattcctagagagttagatgaagcggcagtgatggacgggtgtaatgaatttcagattttgttcaaaatcatcattcccgtaatcaaaccaattctgattaccgttgccttgctaagctttatgtggggcatgaatgatttccaaggaccattgatttatttgaatagttcagataaaacggttctatcagtagcattgaaacaattattagacggtgaagcaatggtctcctatgggagagtattcgctgcttcttgtttggggctgttgcctatgatcgcaattttctttatgggatcacggtactttattgatggtgttgcttctacaggaagtaaagagtagtcatatgttgatcagaagaattctcgcacaaatcgttgattttgttttagggattttaaccatatttcttatctttgtaggaggaattccgctaatcggtcgggtcatcaataatgactttgttgctgttttgactgcgatttgtttgatgtgtgttatgtattttgcactgcaatatccattcatgcaaaatcagcagacgattggaaaagcattctttcagctgcagatcgtttcaacagataaatatcgcaaaaatgttccagtggcagtcatttttcaacgagagattttatgcaaactagccagctgtttcttcatttgcctgccgctactgtttggcaaagaaggagggcatgaggcatctacacatacaaagttaagaattggtaaaggagaaaatagttggaagaaataagacaatttttggatcaagtaatcgcacattcttcgccagaagcacctatttggaatcaagaggctcgattagccaatcatccaatccgttggagttatatcgatggctgcatgattctggcgatccaatacatgtttaatgcaacacaagacgagaattatcttgcgtttgttgaaacctttattgatcactacattgatgaggcagggaatccattggggtacgatgaaaaagaatataactgtgacgcaatcaatgaaggaaaactattgtttcagttatatgcaatcactaagaaaagcaaataccgcaaggctctagataatctgtatcggcaagttttgttgcaaccgcgcactaaggaaggaagcatgtggcataagctggtctacccgcaacaagtttggctagatggtttatacatggttcaaccatttgcgatccaataccaactaacgtttggcaactccgcagatgttagtgatgtgattgggcaattcaaaaatgtcatggagtcaatgaaagatccgcgaacaggattgctgtatcacggatacgactgtacgagaactgcattttgggcgcatccaaagacaggttgtagcgcaaacttttggactcgttctcttggatggtatgctatggcattagttgacacacttgaagttttactgtcccatgaaggctatctccaagaaaagcagcagttgcagcgctatttaacagaacttgtaggtgcagtaatggcttatcaagatccaaaaacgagtctcttttttcaagtaacagatagaccagacggtgaagacaattatttagagacgagtggatctgctgctttgagttatgtgatgctaaaagccagtcgattagctattcttccttcacaatataaaataatcggcgagacgatcctacgcgctcttgtaaagcacaaattggttattaaaaacggagaatttacattgaaagatatctgtttagttgctggcttaggggggatgcctggaaaaggcaactacaaaatcagagatggctcctatgagtattatatttcagagccagttgtcaacgatgatgctaaaggcatcggtccgttcgtttatgcttacagtgaatggttgcaactgcagaaccaataaagacagtgattcttatcattttcgtaagcgcaaacaaaccatttggtctccttcgcagagtaagatacaatgaaatggtaggcaacttccttcaatgaaaaggcaagtgctgaaagatagaccgatttcacgcgtacacaaaataaggaggctttcaaatggataaaagaaacctgacgattattggcagttacgacactcgggctgaagcattgacagcaattgatcaattgcgaaacgaagggtacaacaaagacgacattgttttgtttgcgaatgcaacgatcatcgagcagtttggcttagatacgttaagtagtgcagaagtagaagcgactggaggatcagatgatgatcgttcaatgtgggaaaaaatcaaagatgctttctcatttggcgactatgaccatcggacgattgatgatgagagtgatcctttatttgcctatcgtgacgaccttgagcaggatcgtttagtggtaggagtctacgattatcacgcaaccgatcgaatcgaagaaacagatacagcgatcattgatcagcctgttacaggtgagacagcaatgcctgatgaatcggttcatccgacccctcgaatgggagatagtgatatcgaaacaccaattaatgacccaaatcacttgcgtaatttataaaaaagatcccatccagtaaatggtcggcttataatcaaagaaatagcagccctgcaatggctgttatttctttgtatttcagatgttaagcttgtaaaatacgggacaattgctgcaacgaattcttaatttgttgctcgtttcttttttttgtataatagatggagaaaaccatttcttcaaaaaaatgcacggtacttcatataaagagaaggtgagggatagcaatgaagttgaaatttaatttgcagtcagcactcgttagttgttttgtcacgattatgttgagtatggcaattgatcaagacgtaaatgcttttgttgcggccccgttccagcgcaattcttcggagccatcttctgaagcaccagtgcaggttgccgaaacaagtacgtctgaaacggaaacaaccagtgaaactttttatgaagcacgggtcagttcctactccgaaacaactgcacagaccagtggaacaaaatcaaatgaagattcatcggccattccgtctacagaatcagaaagtatagctgacagtagtgaagcagtagtgaaggagacagatacagcatctagcacttccaataatggatcagcaaattctgatactacgactagtacatccgaaacgacgagctcctctagcagcagctcaagtacgagtagttcaacctcttcatctagcagttcaagcagtacaggcacaactacttctgacgaaagtgaagagagcacagaagctggtgatacaccgattgatagtaatgatccggccaatgctgcggatggatcagaaccattaaaacttcttttagaagaaccatttgatgccttttttagataagcgcttcggctaagatagtcagagttttaaaccagcgaatcccttacgactattcatctatttgctgaagtattgagtgattattttgtgcaataaaaaagcatctttttcaagcatatcacaaagtaatttcattaaattcgcttataatgaggtgaaaagggggcgcgctatgggcaaatattttaaaaactttgaaaagctgatcagtgctgttgtcgatattatgttagcaattttagttgtattggtattggttgtgatggcagaagcaatttataaaatcgttacttatgtcattcctttgacaaaagtcagtgatctatcctttttgattgaagagattgctacactatttattttacttgaaatcattttgatgttattgcggtatgtaaaagaaggacatcatattcctgttcgttatctgattctaatcagtatcacggcgattttacgtgagttattgttggcacaaggaaaaggactggagacgttgtttttggcgctggcgattttagtgctgatttttgttttacaagcattagagaagttgaaatcttttcatagctccaaagatatctgaaaaataaatcagaaagttacttagaaatcaaaaataatcctatcagtaaactgaatgtctcagttattgataggattattttttgcgaacaaactagcactttctgcttgtagttgcttcccaatatccgtttgccgtacagtgattcgtttggtttggcggaggatgattttcttttgcgtcattagatccttccgctccttgattgctgtctgacgatctgtaaatggttggtgagcagcaagtgtcatcccaaaagaattggataacaatgtgtaaccggcgataccggtaacttcctgataggagcgggataagccaccgtcaattaccagtaggtgcccattggctttgattggcgtctctccttttttcacttttactggtgtgtggccgttaatgatgtgtcctgtcgagtctaatccaaacgcagcgaataagcgacggcaaaatgcttctttttctcttagggtatagtaggcgtttttttcttcaatatgcgtgtgtttattactgatgaaatagcgctcgaaggttttcatggattttttaccgaaaagagaagacccttctccgcaccagagataccaaaggacatcggtcgccagatcgtcggtcctttctggtgttgcgaaactctgttttacacattcttgaaagaaatccatcaatgctttgccctgataagaggtttttccaaaggacactgaaaggaagcgaccatcaggatgacaggggatgcaaccgtggtacagtagattgccattataaatttgatagatcgtgcctttttctactagaaaacgtacatgggttgctaacctttcggaggattgaaattgtttgagaagatcctccagtactttttgctcttcatcagtcaaaagatagggtgcttcgggatcaaccaattgaaagcaagcatggatcagaggctcaaagtgatcctctagctgaatctgcaaatcctttgtgattttacccaatagcaaacgatccgctaattgaaattcggggcgtcgtttgatcacagcggcctctaccttgaattgaatgattgcaaaggcttgctggagaagcatggcgtcgtgaatttcctcttcggaaagatcatcaacagttttcttaggataaaaccccttattttcttgataatgtttacgactaaatgctatggctttagagaggtcgatgccatagccttctttcaacaatgctaaatttccataccgtgcagcgatccgtatggtacttgccaaacaagggaaagaaccgcagtaactcccgatccacaaaatatcatggttccctaattggatatccaaagaaggaagcgccatgagccggtcgatgattttatcaggtgcgggtccccggtcataaatatccccaataacatgtaggtgatcaacgacaaaacgctgaatcaaaaatgctagctgttcacaaaatagaggcgctaaggataagtcgatgatcttatcaaaaatcgctttataataggcttctttgttgaagtccgagtcatattgatacagcaattcttctaaaatataagcaaattgttttggtaaagcttttcgaactttggaccgcgtatatttgctggaagtaaaacgagccactttgaccagttgagtcattaattggatccaatcctcatgcggatagtctttttcttgcaatacttcttttggatagtaaatcaaaaaacatagctcggtcttctcagcagctgtcagtgagtattgaaacaatgtttcgactttttcccgaatgctgcctgaaccattgcgcaagatatgatcaaaagcttcatattcaccgtgcagatcactgacaaagtgttcggttgctttaggtaactgctggatcgcctctaaattgataatctcaatgaaatcatttaattgatcttcagtgtgcataggcattatttttgtaaaattcttcgatcaacatcgaactttcttcgatcgaccgtttgctgacatcgattacattgattcctagctgttggaataattgattcgcataggctagttcatcatcgatccggcttggttctgtgtagttagtagtttctttcaaccctaatgaagccagtcgagaacggcgtatttcgacgagtgagtcagaatttgtagtgagcccgatcatttttttgggatcgatttgattgatctctttgggtaaagcgacctcaggtattaaaggcagattagccactttgtaaccacgattagccatatatagacttaacggtgtcttggaagtacgggaaacaccgagcaatacgatgtcagcatcgagaaaaccacgaggatccttgccgtcatcatacttcactgcaaactccattgcagcaacacgactgaagtattcttgatttaaacgatggattgcgccaggttcctgaactgcttgtagcccgacggttgcttcgattactgagatcaatggcgtcatgaaatcgacatgttgaagaccggtgcgtttagcaaaggcttcgacaaatttcactaaatctttgttaacaagcgtcgtcacaacaatcgatttatccagtaaagcatcttgtaagatttccaataagctctcttcatcatttgtaaaaggatacagttgaatatcggatagatcgatcgtaggaaattgtgcggaaacggcactaatcaatttttgtgctgtttcaccaacggaatctgaaatcaaatatagtcgaacattcttcatttttttcgctccttagaattgattgttttcgatcgcattgcctgcttggatatagtagttcataattttagacttggttattttaccaatgactttttttggattctcagcatcaacaacagggagtgtatctatttcatgcctagctaataaggtacctgcagtcaaaatagtttggtcggcagtaatcgtgacgatattcggcattcgcgtcatgatcattgccaccggtgttttttctgctgctgaattgctgatagcgaagcgcagaaggtctttgcgggatagaacaccaattagttcctcttctgcatttttcacataaagagacccgacatcatacatgaatagggttgtcacagcatcatataccgaaacggattgctcaatcattaacggtgggatcataatctctgctacttttgcatggtatagcttatcaaacaacagcggttctacggtctgtccggtataaaaataaccgaccttgggccgggcatcgagtaatccagtcattgtcaggatagagagatcattgcgcaaagtagcacggctgaatcctagtttttttgcgatggtttcaccactgataggttgattgtcttttacgatttcaatgattttaagttgtcgctttgtcaattccaatgtgtcaccttctttaaataaatgtgatatgctatttattatatattttccgcgtggaaaatgcaataaaggattttggcgcgaatttttcttaaaaatttcttcttgacgaatcaatagtgtacgctatatacttcgttttaagcttaatagtatatcacattaggaaggcggaaaaaaatgaagaatatcgtttggttctcagaaggtacgaaagatcaaaaagaattactaggggggaaaggagcaaatttagctgaaatgaccagtatcgggttgcctgttcctgcgggatttattgttacaacagatgtttgccgacaatttttagaaaaccagcaacttacacagccgttggtagaagaaattattcgagcagtagctacattggaagaacgaacccacaagtcttttggcggaaaccagcagccattactggtttctgttcgcagtggggcaaagtattccatgccggggatgatggatacgattctcaacttggggttaactgatcaaacggtacaggcgctggcagcgaatacaaagaatcctacatttgcctatgattgctaccgtcgccttatccaaatgtatggggatgttgttaaagggatcgataagagtcattttgaatcctatttaacgacctataaacataaaaagggatatccttctgaccaatcaatggtcgctccagactggcaagagatttgcgaggttttcaaaagtatttatatggaacatacgcaagaacgattccctcaagatccgctggaacaattattatcagccgttcaagctgtgtttcgttcgtggaataatccccgggctatcacttaccgtaaaatccacaaaattgctcatgatctaggaacagccgtgactgttcaggaaatggtttttggcaatagtggtgctgcaagtggaactggcgttgcttttactcgcgatccgacgacaggacacagaggattatttggtgaatttctcgcttgtgcacaaggagaagatgttgtcgcgggggttcgtacgccaagaccgattagtgatttagccaaaacacaaccagaaatccacgcgcagttttcggcgattgccgagttactggaaaatcattacaaagatatgcaagatatcgaatttaccattgaagaagggcgattatttgttttacagactcgtaatgggaagcggacggccaaagcagctgtacagattgctatcgatctagtttctgaaggaaagatcacgaagaaaacagcactgcatcggttgacaccagacatgctggatcagttgctgcatcctatcttttctccggaatctcttgcgaaagcttctcctcttggtcaaggattgcctgctagtcccggtgcagcggtaggtcgtgtttacttttcggcagaagcagcggttagtgcacaccaagcgggagaaaaagtcatattattgcgacaagagacttcaccggaagacattgacgggatggtcgttagtgaagccatcgtgacttctcgaggcggcatgacttctcatgcggcagtcgttgcccgaggactaggagtatgttgtgtggcaggttgtgatcagttagctgtcgattcatttttgaaacaagctcgatgtggtgaagtaatcattcaagaaggagactatctatcagtggatgggacgacaggcaatctgtatcaaggggcgctatcactggttgcctcgcaagattttggtttgctgcagacgattttagactggtctaaagagagagcagacttagtggtacgtgcaaatgcggaaactatcgaagaaatcaagacagcagcttcttttggagcagcaggtatcgggctagcgcgaacggagcatatgttttttggtgaagctcgaatctggccgatgcggcaagtgattttagctgaaacgaccgaagaaagacaagtagctttgtctcagctgaaaacgtttcagttaaatgacttcaaggagttattactgcagacaaaagaacagaaatgcgtcattcgtttgttggatccgccgttgcatgaatttttaccgcgaccacaagaatatgaagaaatggccaagcgcagcggctattctctagaaaaaatcaagcaacgaatccatgatctacaagaagtaaatccgatgatggggcatcgaggaagccgtctaggaattacttatcctgagatttatgagatgcagacagctgcaattatcgaagcggcactacaagcttctgatgcaggaagtgttgtttatcctgagattatgctgcctttgatcagtattccggaagaaatgcgcgttttgagagaacgtcttgaaacgtacattcggcaaatttttgcccactatcagaaagaagtacctttcaagattgggatgatgctagaaacaccaagagcatgtttattaacaaaagaattagctccgctagctgattttttcagttttgggaccaatgacctgacgcaaatgacttttggattttcacgggacgatgctgctggttttattcaacgctatttagataaaggaatcctgtctgaggatccgtatcaacatcttgataaatcgggagtaggacaactaatggaacaagcggtggcttcgattcgtcagcaaacgaagggaaaagcgattggtgtttgcggtgaagtaggcggtgatccacaatctattgcattcttgcgggctattggtgttgattatgtttcatgctctccatatcggattccagcggcatggttagcaattgctcagtctgcatcataattgcttatactctgaccatctatattgctacttgagtggagtctgcaatgaagttgttaacatgcggtcattatcaacgaattgtctgtttttctaaactgttaatttatgaatagctcgaacattctcaagtaatttgatcttcagtataccggttttctaaaagagtctattactatcgttctaaaagcccacctttggctgttgaaaaaatatatcgttgttttttgattctatggaaattcttattgtgctcgtttaactaaaccatgcggtatcaccgtatggttttttagttgattctacaaggtttttagctattgttttgagtggtttctcctacaggacgatttcggttcagtgttatttgtatggtggaaaagcaatggctgcattttctactaatgaacgctcttaatagttcggtgaaatgaccgattatctttactgagggtcgtcttcagacgagtcttcattggatagtgtgaaattgtaaatgaaggagtggcacatttgtgaaaaaaaggaaaaaaacgataggaatttatgtgatggtcaccttgattttggttgcggggatcccgatcattgtcatgctgacaagttcttatttgaccacaaaggatttattgattcaacgaaatgatttgaataaagaaagtgccgttaatttgattttggcggaagaaaaaagcttacgtcaatcgacggaaagaaaattgaagtcaatggctgaactgccatccatgaaaacagaatttagtatggcacgtatccgctcagatctttctttagcaattgctggaaccaatagctttctagaagtgacatttggaacggaagatgatgagtatgtgaccttcaaccctttgccagatgattacaaaccaacgactcgtccttggtacaagggggccgttaaagccgaaggagaagtatattggacagacccatatttggatacggtaacgaaccaatttgtgacatcagcctccattatgattaagaattcccataatcaagtaggggttttgagtgtagatgtttcatatgaaagcattcaagacattttgtctgactttaccgttggacgaacaggaaatattacattagtttcagaatctgggatcattgtcacttcaaagaacacgaaacaaatcggtaagaatatcaaagaagaagaagtattccaaaagatcaaagaagcaaaagatcctaatggtaaggtcggtttgggcgactcaaataaagtcaacgatgtgttgtacgacaaatctgctgattccaatgtttgggcttattccgaagtcaaagccagtgatttagataaagagttaggagcgttagtccgcacgacgatcatcgtcacaatcctgatgttgctatttgtaggacttgtttcctatgcggccattaaaatagtagcagcgatcatcgattgtttcaatcactactttagaaaagtcggtgaaggcaaactagagaagatgagccagtctaaaagagttaaaggcgaaaaatggacttgggaccagttagcccgtcgagtcgtttatccagataaaactgggaatgagattcagcaaatggcagacaattataatgtgatgatcgaaggcactggcgcattgatccaaaaagtgcaaaaagaaagtagtagtgtcgcagaaatgtccgattctttattggaactttcaaaacaaaccaatattgcgacagaagaagtctctcaaaccatcacgggtattgcagaagttaccggtgcacaagctcaggaaacagaatatagtgtgtcgcaaatgcaaaatcttacgcaagtaattaaagaattacgagataacgttggcggaatgagcagcaagtcgcaagaatccacgaagattaatcaagaaaacttaacgatcatggatcaagtcgatgacagctggcgtcaagaattggcacagatggaacgcttaatgtcaaacatgacgggaatgaatgatagtatccaaaacatcaattcaatcattggggtcatcaacgatatttcttaccaaacaaacttgttagctttgaatgcttcaattgaggcagccagcgcgggagagtccggtaaagggtttgcagttgttgctgctgaaatccgtaaattggcggagcaaagtaaagcttctaccaaagaaatcgaagcgattattgaagaaattcgtgagcaatctagtcaaatggtcaaacagacgtcagcttctgtaaaaggtggcgtacgacaaaccaacttaattaaagaagcaatttcgtcttcaaaagaagtatttcaacgcagcagttatatgattgaaggtattcatcatattgaagaagcaagtgcacgtattgaaaacattcaaaatagtgtgttggaaaacttagaaaatatttctgcatcaacggaagaaaatgccgctggtacacaagaggtttccgcaaacgcggaagaagttttagctaccatggatgaattcaccaaccatgtggcagacctaagagacatcgcggaagaattgaagcgattgactaatcgatttgaagtggaaaaatagaacaagaagaaaacattcatcagctattcgaaagcatagctggcgaatgtttttttactatcaaagaagatgctacaaaaaaagccaagactgatgtcagcagtcttggcttttcatgaagatgtttataaacaattattgctggttagtgagccatttctgtccgctggatgatcatctctacacgacgattttccgagcggccttgcggggtgttattatcagctttgggttccgtatcagcaaaggcttgaattgcggcattcttttctaagacggcccctttactgatgaaatactccataacgttaatggcacgggctgaactgagatcccagttggattggtatcggccattgcctttttccggtacgttatcggtatgacctgcaatcactattttgttggtttttagttttttcagtgagtcagagagcaaatccagtgactgccgagtggtggctgtgatctcagcactgcccgatgtaaacaggatactgctagccaaagtgatatggagcccatcagattctaagcgaacttctgtttgatcttttaggcctgaagaagctaattcttgtgatagctgatcgctgattttttgcaattgttgattttccagttgagtccgtacagaggcttcctgtgcttgtgcttccgtagatgtgggtgctttttttcccgtattagtctcccccatatcgatcacggatccgatcacagaggagctgctatggtgactagaaaggatggtgccaaattcacttctgatttcttgaaatttctcatcatcgactttcgccatagcaaacatgacaatgaataaagccagcagtaaggtcaacatatctgagtaaggcaaaagccacgcttcgtctacgtgttcttcatgtttcttttttcgcttcatatcggttcatcctttataattgttcttcccgttttttaggatcgatcaagctatataacttcttctcaatgctttttggcgattgtccggcttggattgctaagaccccttcaacgatgatcgacatcatttggacttcttgctcagatttcaaggatagccttgagctaaagggaatgaacagaacataaccgaagaaaataccataaagagttgccacgaaggcagctgagatcatgtgtcctaaagcttctacatcttctagattgcctagcgccccaatcagcccgatcacggcacccaagacccctaaagttggagagctagttccagcggttttgaagatagacgagccaatacgatggcgttcttctatcccatagatctcattctccatgatttcttgtatctgttcggcagcaatgccatcaaccaccatttctaaaccttttcttaaaaatggatcttccaagttttggatggcgccttcaagagataataaaccatcacgacgtgcttggttggccaattcaacaatcgtattgatcgttgtttttaagtcgtattctttatttttcagcagagcgccgaagattttcgggatttttttgatatcactgctgggaaatgaattgataacggctgcgatcacaccgacgaaaataatgattgcggctgcggggttgattaggacagccacattggccccttttacaatcattccaaccaccacagatatcaatcctaaaataataccgatcagcaagaaaaaatccatttgttgcgtcctcccaaattctttattccgggttttaacccttttctatttttatcggtgaattaaaattattcttaatagcaaaaaaaataatcctaaaaataactgagataaaattactgattcttttaatttttgtttttttggataaaaagtccaagcttttttatgaatggtatagtttgtagatcctgtggaaattttcagatggtatcgtttttttggtgaagtatttctcgtttttttaccatttatacaggcgttcagtaaaaaaagttaatcatttatatacataatgaacgtttttttatcaaaatgcatccttttatagaaaactaaagatagccatataaagcgtttaatcgagagagacttctttttaaatttgctgatcagtttgtgatgaaacctaatttaataaataacataacatgattgtaacttaactgacatatctgtaaagttgtaaaatcaaattgtaaaataaaagcaattctactataatgacatcacgaatgacatcacgtgttcttgtttttttaatctataatataaaaaaatattgaaaaaaataaatatatttttctctggcccataaaaaaagcatttggtacagaatatggaaggagcaattactgttggatacctataatttattaaaaacagccatgaacgtttctgcacaacgcgcagaattgatttcgtctaatatcgccaatgtcaacacggatgggtacaaagcaaaacgcatcgtgtttgaaagcgaattaaagcaggcactcgcttcatcagggacggacgctgcaacagaagcgtcagtttctcaagtaaaaccgaaaatcactgaaaatgcaactaccagcatcaaagacaacggcaataacgtggatcttgaagtggagatgttggatcaagtagccaatgggttatattacagtgcattgaccgcacaagtcaacggacgcttgcaaatgatgaaccttgtattgagtaattgatagaaagcgcaggaaaaacaaatgggtatgtttaacggactaacgatcaatgcgagcggtctagcattggaacggttaaaactagatacgatctccagcaatatcgcaaatgtaaatacgaatcaaacacaaacaacagctgcttatcaaaaaaagagtattcttttttcagaaaatttaaaaaatagtcgcgaaggaacaccggctacatatggtgtcaaagtgacggggatcgctgccgatgagacagaaaagctgacctatgatcctaccaatcccgctgccaacgatgagggatatgtcggtcaatcaaatgtggatattgccgatgaaatggtggcaatgttgcaagcggttcgaacgtacgaagccaatgtttctgcatccgaaatgaataaaacgatcttgaaaaaagcattagaaatatcaaaggggtaacgagaaaatggatggacttttaacgacaggattaacagactaccaaaacgttttgcggacactaggcacgggggctgcttcaaacgagaccagtgttgcaggcgccaaggaaaatcagttttcttcctacttgacccatgcggtcgatcagttgaatcaaaaaacgacggtcatggatcaagatactgtaaatttgatcaccggcgatgaaagcgatctaggcaatgtgatgattcgtatgacggaggcgcaactggcgctacaaacagccgttcaagtaagaaacaagtgtttagaagcttacaatgacgtgaaaaatatgcagttttagcagtgggtgagggaataaggataaatgatggataaagtgaaagaatggacagaacaactcaaagaccgttggcaaatgcaaagctctttaaagaaaatgatcgttgttctttccgttatcagcgttctcggaatcacagcagctgtttattatttaaatacgcgaattgaatacggtatcttgtttacggatctgagcgatgccgatgcgggaacgatcagcaaggatttggaggaacagcagatcgcctacaaattagctgacaatggaacgacgattttgatcgataaggaccaagtcgatgaataccgcatcaatcttgccgtggacaataagttaccaaataccagtacaggctttgaattatttgatgatgccaacatgatgacaacggacgaagaccgcaaaatcatgtatcagcgggcagtaacgggcgaactacagcgagcgatcgagtcgatcgatgcagtcaaatccgccaaagttttactcgtgatgccagaagaaagtgtcttttcttctgaggaaagtgcgccaaccgcctccatcgtgttgaccttgaaaaatcagcagatctcagacgagtccgtgcaagggatcgttaccttgacttccggcgcagtggaaaagctgaagccagaaaatgtaaaagtcgttgatagcgcgggcaataccttgactagaaccgaagatgaagccagtcaattaagtggcctgaacaataaatacattgccatcaaagattcctatgaaaaaacgctagaagaaaaagtagcgaagttgctgacaccgatctatggtgcagacaaattccaagtgtcgatcaatttagacttgaattttgattcgatcgagcgaaagaaagtcacttatgatgacccagagatcaagagtgagacagtgcaggctgctggttcgcaagggaccgtccaagaagcccaaacaggcacggtggatgacaatgtctccaatgtgacgggcacagatggagagggaaacaattcctacagccgttccgttgaaaacgaattggataccgagaccaccacgaccattacggcccctggcatgatcgaacgaatgaccagctcgatcgtgatcaatgcgaacctttcgcaagcggatcaagcagaattgcagcagttgattgctagtgctgtcggctatgacaatgaccgtggtgatcaaatcgcgatccaaggatttgactttgcccaagcagaggttgatccagccgctgatccgcaagggaatgaaccgattgcagctgccaaaggttatctcaagtatgccatcatcggcggcatcgtgttgaccttgttcttagtgatcttaatgatcgttggcgtgatccgacgtcgtcgtaaagaagacgagctggaagtcgatgtgacggaggaaatggtcacttttgcacaaccgtccgtagttagcactggagcaagtccgacagttgcacaagaagtcgtttttggtggtgtcggcaatcggtctgctgaaacgaaaccagcggcgccagaagcatccacacaagaaaccgcagcagaacattcaggagaaccaacattggatcaaacggctagaaattatgccgaaagcaatcctgaagtagcggcggaattaatcaaagcttggatgaaagaaaaataagggggcagccatggatacaatagatggggtaaaaaaagcagcgattcttctgatctctctaggatcagatacctctgcaaagatcatgaagctgctgccagaatcatttatacaaaaagtgagctatgagatcgccaacatcgactttgtcagtcccgaagagcgggatcaagtgttggaggaattttctcataccgcaacggcccgcaaatatgtcttagacggcgggatcgattatgccaaaaatttgctgaaccaagcattaggccctcaaaaagccaaagaagtcattgacgtattgactcagattcagctgcgggaacggccctttaatatcgctcgcaaagccgatgttcaacagttgaccaatctgttgatcggtgaacatccacaaacagtagcgttgattttatgctacatgcagccggacaaagcggccagcgtcttgtcgcagtttcctgatcatttgcaagtggagatcgctgaacggatcgggacgatctccagtacgtcgcctttggtgatcgaacggatcgaaaaagtgatcgagaacaaattctcgaattacattgagaacgatacggaaaatgtcggtggtgtgcacacactggtagaaatcttgaactcagtcagccgcagcaccgaaaagaacattttgaacgacttagaaaagcggcaaccagaactatccaacgaagtgaaatccagcttgtttactttcgaggatatcgtgaccctcgaacgcttggatgttcaaaaagtcttacgagatgttcaaaacgatgtcttagtcttagcgcttaaaggcacgaccgatgacatcaagaactttattttctccaacctctcatcacgggcggtggaaaatctacaagaagaaattcaatttatgggtcctacccgcttgtctgctgtagaagaagcccaacaaagtgtggtggctgtgattcgacggctagatgaaaccggtgagatctacatcggaaggggcgaccaagatgcagtggtcaaatagcagtttattgaagcagcaggcggtcaaaacgaccgaagctgctcgcagtattttgacggatacgaccatcaaagtgccgattgagaaagcaagcttagacccagaactgcaagcggctagacgtgcacgccagttggagcaggaacggcatttgcagcaaatggaagccttgaagcagcagattttgaccgatgcacaagcacaagcagcgcaaattctagcagaagcgagagcggaaggctttcaagcaggacaagcagacggctttcaacaaggctatcaagaaggactcaatgccagcaaagaagccgcgcaagcattgatgtcacaagcccaagccaatgtcgctgaagccgtttctgagatcaacacctttcgctcagaaaaaaagcaagaaatgatcgcttacggcacggcaatcgccgaagccttaatcaatcaacgttttacagacgagcaagcaggcttcctgccttttgtggagtctgtgctatggcaatttgaacaacccgatcaatttgtgactgttcgcagccaagagcagcatcttgcagcgttgcgagaattgatggaaaccaaaaagcaggcgatcagcgggtttcgctatttactcatggcagatgacagcttggcggaacacgatttttgtatcgaaactgaaaatgccttggtggtttttgaactgaggaaagaaatcgatcgctttttgagccaatttctagaaagcagtgtgaaggaatgacgtttgaattaccgatcacagagatgcgcaaaacggcgcaatcacagccgttttttaccacctacggcaaagtcagcgaagtcgtaggtctgctgatcaaagtcgaagggctggcggttttcataggagaaatctgtgaagtcgcactgcaaaacaagacacatacagctttagccgaagtcgtgggctttgtgaaaaaaaccgtgctcctgatgccccttgatcagctagaaggcatcggacccggctgtttggtgcggccaactggcaaatcattgacggtaaaaatcgatgatacgctgctagggcacacattagatggactaggacgaccgttagatatggcgctggatctggaaagtgcgccagaatatccagttagtcaagattctcctgacccctttcgtcgtcaaaaaatcgctgagatcatgccgacaggtgtccgggcgatcgatggtctcttgactgttggccttggccaacggatcggcatttttgccggcagcggggtcggtaagagtaccttattggggatgctggctcgttattgcgaagccgatgtcatcgtgatcggcttgatcggcgagcgaggaagagaagtcaaagaatttattgaaaatgatctaggcccagaaggctaccgcaagtcggtcgttgtctgtgctacctccgatatgccgcccctcgtacgactaaaaggggctcatgtagcaacggcgatcgctgagtattaccgcgatcaaggcaagaaagtcgtattgatgatggactcggtgacgcgttttgcgatggcacagcgggagatcggtctatcgacaggcgagccgccgacgaccaaaggctataccccttctgtgtttacagctttaccgaagttgttagaacgcagtgggatgtcggacaaaggctcgatcactgctttttataccgtcttggtagaaggtgatgacatgaatgaaccgatcgctgatgcggttcgggggattcttgacggacatattctgttgtcccgaaaaatcgccgctcaaaatcattatcctgccatcgatattcaaaatagcctcagccgcttgatgaagaccctcgtttctgagaagcagcataaacatgcgggggaactaaaagaaaacatggccgtttatgcagaagccaaggatttgatcgatatcggtgcctacaaaagcggcagtaatgcgttgaccgaccaagcgatcgcgctgcatcaccccatcctacggtttttacagcaaaaagtggatgagcggatcccatttgaacaaacgatttttgaactggcgcatttgttcagtgaagaagcgctgatcgagcgccagcgttcaactatgtaaaagagatcataaaggagcagctatgcaagcatttcacttttccttagaaaaagtattggatcatcgaaaaactattgagcaagaagccaaacgaacttacgcccaaaaacaacaactattgattcagcaagaacagcgcctgaatacgctgacacaggaaaaagcccagctttttgatgtcaatgagatgaccattgggcggatgcaagtgcagcaacgttatttgcttgcgttgaatgccaccatcgatgaggttcagaacaaaatgtttcacgtgaagcaagaattggcagagtcgttatcggtggtggtagaagcgcagcaggaacgcaagatcgtggaaaagctgcgagaaaaacaatttgctgaatacatctatgaagagcaattggaagagcaaaagcaattggatgagttcggcaatcgcgccttattttcttaaagaactaatggttttagtgataagacgaccttggtttcaaagcatcagctgagaggaggtgaacaatgaaagagatcacaacaagtgccgtatcccctgtacctgtcggcagcaaatcaaaaaagacggaggcgtcaccagaagccttcagtttgctgatgcaacagctgacggaacagaccgcaagcaatctgtcagcaccctttgaaacatcaggcatgacggagcaaaacgccgttgcaccagaaatgtgggttgccagcagtatggaacatctgccgcaggagccagaaatcacttcagcacccgaacagcttgcaacgacacaagcgccaggaatgagccagatcagccaggcaccttttgcagacttggttcatgaagcgccacaggcatcgatggtaacggcggagcagaaccaaacgagcgccggcacagcagcttctcccgacagtgtttcagctgctttagcaccaatagacgtagccaccacagtcatcaacccctccgagtctacgcttgaaggtctagatttgatgacaaatgacagaagtgaagccgcagcaacaacgcttgaaacgcctttgccagaagacttagtaggcgaagagcagtccacggcaaaagggatcgctcctttcaaggaaatcaaggaaatcgattcagtaacaaaaactgcgattgcggagacgacagaagcacagctgaaacagtccaccgaagggatcgctcaattgggccaaaggggaccattggatcaagcgtcgccagtgacccaccaagcgacggatacgactagtaccttgcaacgcacgaatgaaacagtcgccaaaaaagcggaagctgtttctgcacaagccattgcttcttcaacagcaactgacaatgaaatggtggcaccagcgctgcaactgcttgatgtttctccccttttgaccaagcaaggacccacgccaacaaaagcgaatatggaacaagcggtcctacccttagcaaaagcggctgcccaactcgtccaaacgagcagcacggcaagcgagaaaaaaatcacgctgcaattcgttcctgagaaattaggcacgatccagctttctctagaaacgaatgcccaaggcagtcgcttagaactgactgttcagcagccgcaagccaaagaattattgctgtccatcaagcatgagctagagcaagttttgcaaaagcaagagcagccgatcctagtgatcaaagaacctacgttagcttctgtccagcaggctggtccgctgtcaaatcaatcctttgccggcagtatgatggcaagtgacagtcagttaagccaacagcgttttttacaggctcaaaaaggacaaagcaaaaagccgtttcatcaaagcaatacggctgaagaagagcagcaattagcaccgatcgatcatgcgatcagtattttagtgtaaaggaggagaactatggcagatgaaattacagcagctgcggccggtattgccaatacatcggcattaacgcaaacaaaaaaatcttcagatatctccatggatgattttttgaagatcttagcagcatctatgagcaacccatcgatgggaggcagcgattcttctggtggtggtagcaccgactatatctcgcaactggttcaatttacgaccttagagagcttgaatgaattgagcgaaacgttgacgacctcggtgattttacagcaacagcagcaagcttttagcttgatcaataaacaagtcaccctgatggacggcacagaaacattgtcaggaaccatcgaaaaggtccgctttgccaatggctacgccacgatcgtcgtaaatggcaaagaatacagtatgagtgcgatccaagagattggtggcgaagcaaaatgagtttgacgattcaacaggggctgcaaaaagttgccggggagccttatcaaaatccccgcaaagtcgtggacaaacaagccttttcttcaatacttgaacaaaaacaaaacgacatcaaagtctcgcatcatgcgcaaaagcgtttgactgcaagggaattgaccttacaagatgatgattatcaatccctttcaacggcgcttagtgagctagcggaaaaaggcagcaaagaatcactgctcgtttacaaagatatgggcttgatcgccgatgtccattcacgaaccatcattacggcgatggggatgaatgaacttcacacagtcaccaatattgacagcgccacatttatcaaatagcagctggactgaaaaggggctgcaagtattttctgaatgacagaggaaaatacgccaaccataaggaggaaaacaagcatgttacgatcattatattcaggtgtcagtggaatgaaaaatcttcaaacgaaaatggacgtggtttccaataatatcgccaacgtcaatacggttgggttcaagtcaagtcgtgtacttttccaagacatgatgagccaaacgatgtcaaacgcaactgcgccaggcaacgggttaggtggaatcaacgcaacgcagatcggtttaggggttcagacgggctccatcgataccatcaatacagtcggtgccccgcaatcgactggccgcagcatggatttttatatcagcggacagggctactttatggtacaaggaccaggagcaaatggcgaaacctattacacacgagatggcgcattcgttcgtgacagcaacggaaccttgaccaatagtgatgggatgcaagtcttaggtcgttcagtcaccggcggtcaaccggttgtctatgatgacaactttgatgaaaacacagcattgagcggacaagaaacggtatctcccttatcaattccaagtacactgaccgtcaatggggaaaccttgacctataactccatggcaatcgatgccaatggcttagtgttggcaaaatacggcaatcaaacctttgtgatggggaaagttggtgtcgcaacctttaataacccagaaggcttagaaaaagtcggcggcaacaactatgtccaaactagcaactcagggaatccaatcgtcgcaggccctggcaacaacggagcaggaacgctacaggcgggtgccttggaaatgtcgaatgtcgatctttcgacagaatttaccgaaatgatcattgctagccgtgcctatcaagcaaattcaagaagtattacgacttctgatgaaatgctgcaagaattattgaatctaaaacgttaagaacgtgacgcttcatcattgagaggagtttgaccatgattctagtgacagcattgaatggcaagccattctatttaaatccaacattgatttatcggatcgaagaaatgccggatacattgattacactgacagacggcaaaaccttagtggtgacggaagctgcgcaagaagttgcgcagcgggtaatcgagtatcatatggtgatccattcgaaccaagtgaaaacgtaagggtgggaaagatggcaaaagaagaaaaagcaccaaaagcagaaaaagagaaaaaaggcttgagtatggttgttttactgccgatccttttgattgtggtagtcggcggcagtatcggcggtaccttagtgacgaatcactttttgacgggggaaaaaacagcagctgctgaaacagcaaaagacagcagcaaaatctcctcagacgaagcgatcgtggcactggatgaatttttagtcaatctggcaaaagaagacaaccaagagcagcaatacatgaaggtcaatttatcgattttagtcgccgatgaggaaaaaagcgcggaagctacgaaaaatgtggccgtcattcgtgacagcgtcgtaaacttattgcgccaacaaaaggccagcggtattttgagctccgccgaaagtgtaccgaatttaaaaaaagcattgaaagaaacaattaatcaggaatacggatcagaaatcgccaaggatgtttatgtgacggatttagtgatccaatagaaagaggcgtgttgatggaaacatttttatcgctggtcaaaatgattgggtttttgctgcttattctttatttgatcaacatcagtttgaaatatttaaatcgttacacgaaccagcacaatcaccagttgcgtattttacaaaaaatcgccgtcagcaagtcgtcttcgatcgggatcgtccaaatcatggacaaatgttatgtcatgagcttttctgaacagcaaaatcagatcatcaaagagttgacgccagaagaaacggccgcttttttacagcaaagcctagaaaacacccaagtgcaagctggcaaagatttttctgaatggctcaacaaagccaaggcggaaattgctggaaaacgaggcaagcaaaaatgaagattaaaggcagagatatcaagatcatggctgcggtccttttcagcagtttgatgcttccgcagacggcgtttgcgctcgacacggaagacgtcagctccaccatcaacaatttattgtcgaatgggaatggctcaagtgatacgatcaataccttcttgttgctgacgctgctttccctcttaccggtcttgctgatcatgatgacctcttttactcgtatcatcatggtcttgtcctttgtgcgcagttcgttaggtacacagcaaaacccgcccaatcaagtattgatcgggttggccttattcttgacattttttattatgaaacctgtgtataccgacatctaccagcaagcgatcgaaccgtttgatcgacaagagatcagccaagccgaagcttttgaccgctcagaaaaacgaatcaaggcctttatgatggtacagacacgggaaaaagacattgccttgtttgcggaagctgatggggagaccgaaaagtatcattcttctgacgatgttcctctgaccgttatggtaccggcttttattatcagtgaattacgaacggctttcagtattggctttttgatttttatcccctttttgatcattgatctggtcgtctccagtatcttgatgtcgatggggatgatgatgctgtcgccgatcatgatctcactccccttcaagatcttactatttgttttagtggatggctggtatctgatcgtggagtcgctgatcaagagttttcaatagccgctaagaaaggagccaagaggaaatgacagtagaaatggtacttgatgtgctaagggaagcctttcttcgaattttagcgatatctggccctgccttattggtcggcatgctcgttggattggtgatcagtatttttcaagccactacccaaatccaagaacaaacgttgagctttgtgccgaaactattagcgatttttttgaccttgattttggccgggaattttatgctgaatctcttgttgaattttaccaaaatgatcttcaagatgatttcagcaatgtaaggaggaaacctgatggcgccgattcaagcgacggtgttgattttttgtcgattattggcgtttgtcgtcctttgtccgatcttctcacagcaaaattttccgtcactggcaaaaatcgtgatcggcatggcgttgacggtcctatgtctgccgacggcacctgcgattcccgagctttccctctttatgatgacggttttcgtcatcaaagaagtactgtttgggatggcgatgggctatttgagtcagctggtctttaccggtgtggaaattgcgggccaattgatcgactttcaagtgggtttttcgatggcgcaagcctatgatccgacgttgcaaatcgcctcttcccagtatggcaaaacgtactattggctgacgatcgctgtgttttttggacttgatctgcatcatcgactgattacagcactgctgttgtcttttcggatcgtgcccttaggctctgtggtgatccaaggcacgacggttgaaggcatcgtcaaacttttcagccaaatgatggtgatggcagtcaatcttgcagcaccaatgatcattgcgctgctgttggtggacctcgtgctaggtgtgatttctcggtcgattccccagatcaatattttgatgatgagtctttcgatgaaaaccgccatcagttttgtggtgtttctcttgctattacccaatgtcctttcgtacttaggcaaacacttgccagatacggtccgctacttgcaggagtttatcaagtcttttcaataaagtaacaggcagccagcaggaggtgagaagatggcagaaaaagatggcaaaaccgaactacccagtgccaagcggctgcgggatgcccgcaaacgcggggaggtacctaagacccaggaattagcagctgctgtttcgctactggtcttctcgtttttgactctgtctttatggcagtttttcgccgcttcttttttgccttatttttcccgaagtttggcgcagctggctgattatcaatccagtttggcggatctgccgaaactgggggtgcagagtatcttgctgctgcttttgttgtgtgcgcccgtctttctggtcgcgctcggagtcgggcttattacgaattatgcccaagtcggtctgttgttttcaggaaaggccgtcaaaccagactttaaaaagctgaaccctatcagcgggatcaagcagcaattcagtttgcgctcgttgatgaatttaggcaaaacattggcaaaattcggcgtgatcgtctacttgtgctatcaacaatttttagccgccgtccctgttttactgggtttgagtgaagtggggttggaaaaaacgatcctgttcatgctgctgcgggccaaagaattgttcttacagatctcgattttcttgatcattttggccgtagtcgactacggctaccaacgctatagccatcgcaagaacttgatgatgagcaaacaggaagtcaaagaagagttcaagcaaatggaaggtgatccgcaagtcaaagcacagcgcaaagcgaaataccgtgcgatgacccaaaatgccatcgccaacgtcaaagaagcgacggttttgatcaccaatccgacccatttcgccattgcgattcgttacgatgccagcagtgaaggggtgccacgggtcttggccaaaggggcagatcagctggcgcagcggatgaaagcagaagcactgaaagaaaatatcccacaaatcgaaaaccgtgaagtagcacgggccctttaccgtcaagtagaacccggggatctcatccctgttgaaatgtatgaagccattgctgaaatcatcgctttggtctatcagctagaagaaagccaacgcggcaagatttaaggaaacaggaggaactaaaatgaatgaggctgcctcaaaaccgaaaaaaggcattggtctggcggatatcttaatctcggtgatcgtcctagctattattggtttgattattattccattaccgagtgcattattagatattctgatcattatcaatttgacgatcgcgatcaacattttactgatcaccctgtttaccaaatcagtgttggaattcactacgtttccaaccttgctactgatcacaacgatgtttcgtttaggcttgaatctatcttccactcgtttgatcttgacccaaggaaatggcggacacgtgatcgatgccttcgccaatgtcgttgccggcagcaattacatcgtggggatcattttgttcgtaatcatcatggtggttcagctagtcgtcgtgaccaatggtgcagggcgtgtctccgaagtgactgctcgattcacattggatgcgatgcccggcaagcaaatggcgatcgattccgacctaaatgctggtttgatcacggaagcggatgcccgcaaacgacgaaaagatctgcagcgagaagctgatttctttggttcgatggatggtgccagcaagtttgtcaaaggggatgcgatcgcagggatcttaatcactgtcatcaatttagtcggcggagcgatcattttctccatggggggacaaatgaccgtcatggaagccttcgcccaattcgggaaactggcgatcggggatggcttggtcagctcgattccctctttactgatttcgattgcttccggggtaatcgtgactcgttccgataacgatagttcctttggtttggatattgcggcagatgtgatgcgtaatccccaactgtttcggatcgtgggggcgattctcttcgtcttagccttagttcccgggtttccttttgttccttttgtgttgattggtttaggccttttcgcagccagctttctggttacgcaaaaagaagaaaagcagcgagtggaacaaaaacaatgggaacaaaaattggcactagaacgcaaaaaagaagcgcaggaagaagatgattccgtggcttctttccaagtggaaccaatctcagtggaaatcggttatggtctaatccctatcgtggatagttcggtcgacaacagcttaatgaaccgcattgtggcgatccgtaaacagagtgccagagaattagggatcttagtcagtcccgttcgtattcgcgacaacctctatttggatgccaatgattacgtgatcaagattcgtggcaacgaagtcggccgcggcgatatttacccgaacaaagtcatggtgatcagcccgaatgaagagccgtttccttttcaaggaatcgcaacaaaagaaccagcctttcatctggatgcaatgtggatcgatgaatccgataaggagatggcggatctgcaagggtttacgattatcgagcctttgactgtgatcgcaacacacttaaaagaaatcatctatgcccatgcaccagagctgttaggtcgccaagaagtcaagaaattattggagggcatcaaagagcagtacaatgtcgtgatcgatgaattgatccccgatattttgcggctcggcgaggtccaaaaagttttacaaaatttattggatgaacaaattcctatcaatgacttagcaacgatcttagaaaccttagccgattacggcgttgtcacgaaagacgtagaagttttgacagaatatgtccgccaagcattgaaacggacgatcgctgccaagtatgccaatgaacgacacgagctgcaagtggcggtgatccagccgaaactagaagaaatcatcgctcaaagtatccaaaaaaccgcaactggctcgtacccggtcttaaaaccagataccgtgaccaagctgttggattccatcagtgggatccaacatgcggcgattgctcaaaatatcaatttcgtcattctggcatcgcctaagatccggttagcattcaaaaaaatgattgtttttaatttcccagatatcgccgttctttctctaaatgagattcccaatgaaattgcgatcgaaacggtgggcagtattgacatttaagcagaattttcttaggaaggggcatcgccgatgtatgaagtcgatcgagaagcggagatcatcaagtatctgccgctagtggaacgggtggttcagcgcctgtctatcaaaaccgccgattatgaatcaggtgatctctacaatattggggtgattgggctgatggatgccttgcggaaattcgatccctcaaaaaaagttccttttgaaagctatgcagtgattcgcatcaaaggggcaattattgatgaagtacgcaagcacgccaaaatctcccgttacaaaatggcggcagtcaatcagttttatcaagcacggcaagagttggagcaaagcctcaaaagagaagcgaccgatactgagatctgcaaacagctgggaatcaaccaaagtcaactagcggatatttatgagagtttgcactacttagccagcgtctctttggaagataccttgtttgcttaccaagaagaaggcatgacgataaaggatatggttcgggatcctgccgagaatgtcgaagataccttagtcgctgaagaaaaacgcaccgctttggttgcgtgcatcaaaaaattaggggaacgggaacaaataattttaagtctgtactataccgaagaactgacgttaaaagaaatcgctgaaatcttagaaatttcaattccgcgggtctcacaaattcacggcaaaacgattgccaaattgcgcacattgattgaggaggaactggcatgattcgaggattggatgtcttatcacggaacatttcattattacaaaagcgacaagagacgacgagcggcaatattgccaatgtcaatacaacagggtatcaagcaaaagccttgtttcagtcggcactagatgaagtggcgctgcataattatcaaagcgggcccaatgcggatactcgccgcgatatcggtgggttgtctttagggacgcaactggcaggtagtacgatcagccaagaccaaggcgccgtcaaacagacgggacacgccagcgattttgcactgctttccgaaggctactttgtcgttcaaaacaatgcgggtcagcggttgtatacgagaaatggcgactttaccgtcaatcagcagaatcaatacgtaacacaagaaggctatcttgtcttgggtgccaatggacaagcagtcagcgccttgggaccagcgaactttcagatccaatcatttcccccagaagcactgactacagatggtcaaaactacgtgactagcaacgcagcaggaaccaatgtgaatgcaccagtaatccagcaaggtgccttagaacaagccaatgtatccgttgccgatgaaatggtggcgatgatccagacttctcgggaatttgaagccaatcagaaagtcttgagttcaacgaatcagacattgcaaaaagcggtcaacgaattaggaaagatttgaggatgagtcaatgaatatcagtggattactaggaatcagccgttctgggttgaatcatttgcagacaaacttagacacgacagccaacaatatcgccaacgtcaataccaatggctaccaagcacaaacgacgcactttcaagcattgatggaaaatgccatcggtgcagaagaaacgctgtttaatggcaacaccgcccaatatggtgcgtcaatgggggcgaaggcaaccacgaccacaagttttgcccaaggcaatctggcgggcactgctcagccattagatctcgcaatccaaggcaatggctttttcggggttcgggaccaaaccggtcaattgctgctgagtcgagcaggcaattttcatttaagtgagaacaagcaattagtcaatagtgaagggtaccctgtggcaatgaccacaaacgtaccgacccctcagtggccggatgcgcagcaaatcgcaatagatgccagcggtcagttgacgacggaagaaaatggtcagactcgagtgttgggacagctgaccctttatcagccgacgaatacagaaaacatcacgccagtgggcaaccaactgtacagtgccggtgatcaagcgttgcttacttcgcaaaccaatccggcagcctttggcagcgtcttgcaaggacagttagtacagtcgacggtggatctagcgacttccatgacagacttgttaacgacccagcgtgcgtatggactgaatacgaaagccatgcagacagccgatgagatgtggtccgtgatcaatcgttttacagattagaggagaaagaacatgattcgcttaaccaaggtcagtaaaaaattcagcaatggcacgttggcattggccgatatttctgttgcgatccctcaaggagaatttatctatgtggtgggtcccagcggtgccggcaaatcaacgttattcaaattgctcttgaaagaagaagaactttcggccggttctatccaagtcggcaatgtcttgttggaacaactcaaagaccgtcatctctatatgattcggcgacaagtcggtatcgtcggacaagaagaccttttgcttccttatctgacggttgccaaaaacgtcgactatgcgctgcaagtactaggcactccccgcaagctgcgccaggaaaaaaccgccaaagcgctgcaactggttggcatgtttcctcaaaaggatcattatcccgaagagctttcagtgggacagcgcaaaaaagtagcaatcgcgcgagcgatcgtcacagatccagcagtcttgattgccgatgagcccaccgccaatctggatgcgaaatcagccgtcgaagttatgaaactgctcttgcggatcaatcaagtcggtgccacgatcctattggcgacccatgacagtacgatggtcaatacggtccgtaatcgggtagtcgagctgcaaaacggtcgtttggttcgtgatgaataccaaggcggctatactcgctttgctgatccaaaagatacatatgtctggtgaagatgcttaacttttctagcaaaagatccgattaaagaactagaagattgttttcataatcggataaagaaggagtgacccaacgattatcaagtgaagagcgaatcttgataaacagcacgactgatcattttgcataagaaaggatactgttatgaagaagaaggtacaagctatcatcaaaaaaatccgcttagcggtgttgattccgctaggatttaccctgatcgtattattaggatgctatttcttcgtgatccgcacccacggagacggacaagcagcaaaaagtttctttattttttcagtgatcgtactgctactagaaattgcagtgttagtaggaatgacctatctagcaaaaaaagagacccattcaggcatggatacgttgttggcagaactagaagcagtcggttctggcgatctatcccatatcgatgagatcggcagcagcgaccaaatctccctttttgggcaagttcaaaatcgttttcaaggggttttaaacaccttcaaagcggtgatcgttggcatgcatgaagaaagtagccggatggaaaaaatggtaggcggtctaacgacaacctcaaaaaatgccaaaaattcaattgaaaatgtgcgtcagacgatgaacgccatcgcagatgctactagttcacaagcctccgaagcggaacaaacctcctttgatatggacgaattagccttaagtatcgaagagatccacaaagagatcgaattgatgaacgggtatgtcggtcaatcccaaagcagtaatgtccacaattcagaaatgatgttccatgtgtttgaaagttgggagatcgaacggcaaaaccaagcagaattagtggaaagcatgaacgacatgaatgaagatgtccaaagtatcggaaaaattgttcagctgatcaatgatatttctgaccagaccaacttactggcattgaatgcatccatcgaagcagctcgggccggggaagcgggccgggggtttgccattgttgcagaagaagtccgcagtttagcggaacaaagcagtcaatcaacgaagagcattcgttcgatcattgaaacgatccgcaaaaaatcggaaaaagtggtctctgcagtgacggattcctttgaaagcggcgaaagacagaccaacaatattaacaaagccatcgagtccgctaatgagatctctgacattgtcgaaaaattggtttcaagtatccaaacagttgaatcccatattatcgggatcgttgaaaaaaaagacatggttcatgtttctgtcagcaatatttctgctgccgtttctgagacctctgctgggacgcaagaagtaaccgcaaacctagaggacttctacttggtcatcgaaaattttgaacagaatgtacaagaaattgagacaatcgctaatattcttaaattccaagtggatagtttcaaattctaaaaaggagcggtgacgctaatggaacaatacgttgtatttaaaagtcatcaacaacactttgccttgcggatcgattatgtggtaagggtcattgaggctgcctctttcacacagctgccagaagtggcggattttgttctgggtattcaacccattgaagaggcgatggttccgatcattgacatccgcaaaaagctgtttgatgaatttacgccggaaaccggacaaaatgtggtcttgttgtgtcactggcaagaacaggcgatcggtctttacgtggaagagatcgtcggcattctacccttagccgaaagtcccagcaatgcggaattaaatacgtcaggacttaagcaaaactatatcgaagcctttctgaaaaaagatgatgaacttgtactggcattggagctgccgtttctcttcagctatgaacaagcggcagagatgaaggatgagttaggcgcctatcagacagagaaattggcagccgccaatgacgatgacaatgatgaccgtgaatgaggaactgcatgtggggatctcggagtataagatcgcccaagcgccaactcgtttgatcacggtgggcttaggttcttgcatcggcacgatcatttacgacgaagccagtcatattggcggcttgagtcatattatgctgccagatagtcagccttttttgcacaagcgggaaatcaagcccgagaagtttgcggacttggcattgccggcgatggtcgccgagttgaaactaaagatccgccggcctcgctttcaagcgaaaatcgttggcggcgccaatatgtttcagttccagacccttaatgctgccagcaatattggtcagcgtaacattgaagccgtcgaggaagtcttggatcagctaaacattccgatcgtggccaaacatgtgggcggcagcgctggtcgaaccatggtcgtagaccttcaggatttcaaaaccatggttcggcaagtcaaacaagaaatcgtttatttgtaaaaggagtacagggatatgaaaaaagtaatgatcgtcgatgattcggcattcatgcggaaagtagtgacagatttattgaatcagttgccggatatcgaggtgaccgtcgctgcccgcaatggcaaacaagcattggattatttgaccaaagaagcgatcgatttggtggtaatggatgtggagatgccagtgatgaacggattagagaccttgcggaagatgaaacagcaatcagccattccggtcatcatgcttagctcattaaccaaccaagaaaccacgattgaggcgttagcgcttggcgcacgagattttgtcgaaaaaccagtcagtctatcgatgatcgaaaaagaatggatcgctgaatttcatcaaaagattttagcgatggatcatgaagccggcacagctcaagcactggtgccaacggctgcccaacccactaagctgacgcaaaacagcttgtcgtctcatcttgacgctctggtcattggcgcttcaacaggcggcccgcgtgccttactgggcattatccgtcgcttgcccgcgcatctgcgctgcccaattttgatcgttcaacatatgccagcgggatttacggcttcctttgcgaagcgattagacacagagacaaccgtccgagtacaagaagcaatcgacggcatgcggattgaaaatcaagtgtatctttgcccgggggattaccacatgacgatccaacaaggacatttgcaactggaccagcgagaaaaacggcatgggacgcgcccaaccgtcgattatcttttttcctcagcagccgattactatggtgcgcaactagcggcggtcgttttaacggggatggggaaagacggcaccgctggtttacgacagatccaaacggctgggggctatacgatcgttcaagacaaagaaacgtgtacagtttttgggatgccgcggtatgccattgaacaaggagtcgttgatgaagtcctgccattgcaggatattgaagcaaaaattgcacagatggtcgggtgaagaagatggaagaagaatttgccttatttaatgcatgggtggatcgccggttagggattccattagccgcatacaaagaaaatcaaatgcagcgccgcatccttacgatcatggaaaacagcggggcaaaaacgttgagggaataccagcaattgatcgaaggagatgaaggggtgcgggcagcttttttagcccatatcaccattaacgtaacggaattttaccgcaacaaagaactatttgacgcctttgaacgcatcttgaaaaccattgttctcccgaaaaccacgctgccaaaaatttggagtgccgcatgttcgattggggcagaaccctatacgatcgctatgctgctagaaaaaaaccaaattgctgcagccaatgtcttggccaccgatatcgatatgcaaattttggcaaaagccaagcaaggactctatcgagagcacgaattgcggaatgtctcagcggcagaacgtacccgtttttttgatgcaatagaaaagaaccagtttcagatcaagacagaaatcaaacggcgggttcattttaagcaacacgatcttttgaaagacccgtacaatggaccttttgatgtgatcgtttgtcgcaatgtgacgatctatttcaaaagtgacgctcgggatgccgtctatcaaaaattcagtgatgcattggtcccagggggcattttgtttacgggagcgacagaaacgatcaatttcgcggaacaattcggtctcaagaaaatcgattcgtttatctatcaaaaagtataattttgtaaaggagggacccatttggatgacaatagtgtctatcgtacccttttctttgaagaaacagacgatcatttagcacagttgaatgatcatgtcttgcaattggaaaacgatccacaagacagcgccttgctgaatgatattttccgttctgcccatacccttaaagggatggcggcaacgatgggctatgacgtcatgacgcagctgacccataaaatggaaaatatttttgagttgtttaaaacagggaccttgcaagtgacccagcaatcgatctcattgattttcaaatgtttggatcgcttgtcagaacttgtggaggatctgcgggaagaacgtgacctgcagccagctcaaattgccgatttattggccgaacttgaccaaacggaacattctggcggcctaccaaccgagacagaagcaagtcaaaaacctacagcagcgggcgcattaaacccacagtttcaacagatcgatccttctgatctgtacgtgatcgagcaagcggctggagatggctatcaagccgttcaaattgctgttcgcttagatgcccaatccatgttaaaaggcgctcgtgcctttttgatcatggaaaagcttggtcaaacaggggatgttctctatgcagaaccagatgcccaaacactcgaagaaggcacctttgaatcggatttctcgctgctgtatttgacacagcagacactagctgatgttgagcaaaacatcgccagcaatagtgagatcgaagccttcgtggtggcaccttttgatccatcagccgctgtgttggaagaggcagaagagctgcttcagccagcgtcggcccaagagtcagaaactcctgctctccaacaagcgaaaacagaaacgaaagaaaaatcaccggcgctagcacatcatgcgtctgcccaaaatcaatcaatccgagtcgacttgaatcgcttagattcattcttggatctcgtatccgaattggtggtctatcgcaatcaattagaagatgtcagtgagcgggaaaacatcgaagcagtcaaagaccccttagaacaagtttcacgattgacttctgagctgcaagatttggtcttgcggatccgcatgcagcaagtcaatgtcgtcttcagccgctttccaagaatggttagggacttatccaatgaactgcaaaaagaaatggaacttgtcatttttggggaagaaacggaattggataaaacagtggtttctgagttgagcgaacccctggtccatctgttgcgtaattctgccgatcacggcatcgaagcacccaacgttcgggaaaaactgggcaaacctcgcaagggcacgattcgtttggcggcctaccaagaaggtaatcgcgtgatcattacattagaggatgatggcaaaggccttgatccacaagtaatcaaagcaagtgctgaaaagaaaggcttagccacggcaggcctttccgatgaagcgttgcagcagctgatcttccaccccggtttttcaacagcccaagaagtgaccaatatttctgggcgcggtgtcgggatggatgccgtgcaatcgaagattacccaactagggggaactatcgagatgaagagtcagccgaataaaggcacgcagtttgtgatcaaattgccattgaccctgtcgatcattcaagcattgatggttcgcgtcggcgaagaaacctttgcgatcccattaaatctagtcgaacgcgtggtgatgatcaaagaagaagagatcattcagacggtctcagatgaggtctatcgttttcaagaagagttgattccgttgattcggaccgatcaactcttagcgatcgaaggcgacctatctgagaaaaaattcgcaattatcgtcaacaatgaccaacaatttcacggtattttggcagatgaattgatcggccaacaagagatcgtcatcaagaaaatcgatccgctgctgcaaaagctgaatcgctatcaaggagcaacgattatgggtaacggctcgatcgcactgatcttagacattcatgcgatctgtcagaaaaaaaaggatgaccgcttatgagttatacagcgctgcagatcgatggactaaaagaactgatcaatatcggcggtggccacgctgcgactagtttatcaaagctcctccaacaaccgatcgatatgcgggtaccggaagtcgagattctagcttatgaggatttgtatcagcagatcatggcggaagacaaagaagtacatgtggtgataagtcaaatcgaaggggcgtttcgggggatcttcttgtttgtcttaacggatgaatccgccgcaaaattgcgtcagttgatgatccaagaaagcgatccgtcagaagagttgaagcaatcagtcatcaatgagttgaccaacatcctcaccaattcttttttgatcgcgatcgggcaactgttggaaacacagctgagtgcgtctttaccaagtgccagctatgatttctttggcgcagcgatcagttccatctatttggcaatggcccagtatgatgagcaggtgatggtaatccgtaatgagttcgtctatgccaaagaaacattagaggcatcgttatttttgattccagaaatcggtgtactagaaaacatatttgattcattaggaatttgaaaggggcaaatacaatgtcaaaaaaagtattgatcgtggatgatgcggtatttatgcgcatgaaattaaaggatattttagaaaaaaacggctatgaagtcgtgggggaagcccaaaatggccaagaggcttttgaaaaataccaagcaacgacaccggacttagtgaccatggatatcacgatgccggaagtggacggcttagaggcgttaaaaatgatccgcacgtttgatgcgcaggcgaaagtcgtgatgtgcagtgccatgggacaacaaggaatggtgatggatgcaattcgcgccggtgcggtggactttatcgtgaagccctttgacacggaccgcgtaatcactgccattgataaagcctttgcctaatgcctaggaggatagcgacatgcagatgatacttttcaaaatggcccagcagtactatttgatttcggcggactcggtggacgaggtcattgatgctccttcctttacgaaggtgcccttagcacctgagtgggtagaagggttgatcaacctgcgggggtctgtcgtaacggtgattcgtttggcaaaactgattccgattatggaaccagcctacgaaaaaaatatattgatcatgaagaagcaagaggaaaccaaaggggtcctcgtagaagaagtaattgaagttcttgatatcaccgaagaggatatccaactagacaatcaagagacagaacatgccgttggagtcgtgacgatcggtgaaaaagtagccagtgtgattcaaatcgatcacatgattttttaaaaaaaatgggggattagtgtggatcaggtattgacgcagcaagagattgatttattgttgaatgcgatgagcagcggagagatcgatcaagaaattattgagatagaagacaaacaagccaaagtgaaagcctacgattttcgccgaccaacaaagctgtcgaaagagtacgtcaataccctgcacatgatcttcgaggatttctcgaagatgagcagcagcatgctttctacccaactgcggaccaatgtttctttgcagttggcagctatcgaacaagtcagttatgacgaatttatccattcgataccaaaatttactttattggggctctttcattcgcagcctttgagcgggatccagatgatcgagatgaacccacaactgtgcatgatgttggtagaattgttgtgcggcggtttagatgtttatcaaaacaagccgatcgaaatggattttagcgagaaaaaaagttttactgatattgaaacagcgatcttggaagaagtggtggcacaatttgtacgggtctaccaaaatgtttggaaggacatcgttgccttggattcggttttggatggaatcgatacgaatccgcaattgatgcaaaacatgtcgccgaacgaacccgtcgtattagtgacctttactatcaaaatttttgaagtgaaacatttcatcaatctatgtatcccgtacgtcttctttgaagggatcattgataaattaagtttccgcaattggtttgatagcaatcagccagtcaaccaagacgatagccgcgagttgcaaaaaagtttgaatggggtcggcttgaatttagaagttctgctgggccatgctcaaatgagtctttctgagtttctccacctagaagaaggcgatgtcatcaaactagacaaaaaaattactgaaccattagagaccttcatcgatggaaaaccttacttccgggcaaaacctgggaagcaagaggaccgtttagccattgagttattagacaagttagaagaggagcaaaaactatgagtgaacgtttatcccaagcagaaatcgatgcattgttgaatcaaagtgccccagcccagccgcaaggattagaagagcaagtcaaagtcgacattattggcgaagttggaaatatctccatgtcgcaagcggcgacgacgttgtcttccattcttgatcttcgggtcagtatcacgactccccgggtgtctaaaatcaaatttggtgagatcttaaacgacctcgttgcaccaaaagtagcaacgacagttgaatttaaagaaggccttttaggcagtaatttgatgctgttagaagtcaaagatgccatcgtgatcgctgatttgatgatggggggaactggtgaacccaccaacacccaatttacggaattagagctaagcgccgtggcagaagccatgaaccaaatgattgggactgcctcgacttcgatggcgacgatgatcagccgcaaagtggatatcttgccgccgatcgtcaaactatgggagacaccagaaaacattgagtatagcgggatcgaggcagaggaagagatttactgtatctcattttctttgcgcgtcgaaggtctgatcgaaagcaaaatcatgcagatctttacggatcctgtggtcaacgatatcgccagtgcgatgctgtccgatgaagcgactgtcgttactcgggaaacaccaacaccgcagccaacagcacccgttgctgcacctaagccagaaccagaggctgcatcaaagcccgtggaggtcagcaaaccggcatttcaaacattggcctccagcggagtgaacgatggggataatttggacttgatccttgatgtgccattggatctaagtgtcgtgttaggccgcagcaaaaaaaccattaaggacattttatctttcaatacgggctccgtcatcgagctggaaaaactgacggatgaaccgctagagattttgttgaacggcaaactgatcgccactggggaagtcgtggtcatcaatgaaaacttcggcgtacggatcaccaacattctttcgcaaaaacaacgcattcacaatttgcattaacttgaagaaatcgcaaaaagttaaacatatgggtttaacttttttgtgatttgaccgatagtagagggtagaagaatgagaacggaggagaacctatgaaaatcgaaagaggttacgcagaatacagcgacaaggccatcaaacgcgatgcggtcaaacaagaaaagccaactgctcctcagacagaaaaaaccgtcgatgttcaattgtccgaaacagctcaagccattcaaaagagtgccaatcaaacagccagtcgcagtgagcgagtggcagaattgaaacgagcgatcaaagaaggcacctaccaagtatctgccgaaacgatcgccgataaaatgctgcagcaagatgaaaagcaggtcgactagatgacagagcgggaatttgagcgtcagcttcagcagttcttgcggttgctgcaaaaagaaaagacctgcttgatcaaaaatcaagcagaaaaattaccagaactcgtcgagaaaaaaaccgccttcgtacccgttttttccatgtatgaaggaactctttcagcggcgatcaaagaactcatccgccagatccaagtgcagcaagccgagaatctcctgctgacggaacaagccattagtttccaaaccgttttgatggatgcagtcaaagaaaatatcaagacaccagcaaatacgtattcgaaataccaagaaaaacaagttgtctcaacagcgatcatcgatcaaaaaatgtaaggagtacttctatgacaggactatttggttcattaggcaccgcaacccggggcatgaccgccaatcaagcagcgttgcaaaccagcagccacaacattgcaaataccaatacagacggctactcaagacaacgagtcaacttgcaagccgaagcgtcttatcatttagcgggcgtcggcagcatcggtatgggtgtgaaagtcggcagtgtcgaacggatcgtcgatgattttgtcattggacaagtacgcaatgccaattctacctatacatattacgaacaaaaagcagacatattaggacagctggaaagtttaatgaatgagccttctgacaatggactgtccaaacagctggcaacgatgtttgattcttggaccgcattagccaacaatcctgaactggatacgtctaagaccctcgtgctggaaaacagcagtacgtttgccgataccatcaaccaaatgggcaaacaaatgacgcagttgcaaagcgatacgctggataccatcgaaaaatccgcgctggacttcaatgagaaggtcaaacagctgcaatccttgaatgaacagatctatgggttgacgacgagtggtgaaacacccaatgatctcttagatcgtcgagacagtctgttgaaagatctctcgggtctagcagggatcgaaaccaagaccgatcaatatggccgtgggtttgtatccatgagcggacagacgattttaagtgctgaggaacgcaatacccttagtgtggtggtgggacaaagcgacacaggcgccttggtttccaaagacggcaacgccttgaatcctgctgaaaccattacaggatcttatccagctggaaccatcttgttgacgaaaaccaccgacaatggcgacaccgcctatacagaattgccgatcaaagaaggcgcaatcggcggcctgcaagcatcatctggtgagatcggcagccgcttgacggaattgaacaactttacgacgacgatcgcgcaagccatgaacatggtctttaccagcggcgcttctcgtactagcggtctatttgagatcggccaagatgatactggtacagccacgacgattcgggtcagccaagcactgttagataacccaagtctggtggccggcggaacgagcaatgcagcaggagatggttcaagagccgctgcaatggcgaaactcagcagtgccaaattggatttcccattgtcagaaaagacgatcgcttcttttgatcctgagacattgacgtttgctaatgcagcatccggaatgagtgtcagcagctattttaacagtatcgttaccaaaaacgggatctcaaaacagcaagccgacaatacggtcagtgctcaattgtcactgctgaatcaactagaatacaaaaatcaatcggtgtccggggtttcattaaatgaagaaatgtcagatgtgattcgtttccaacaaggatttcaggccaatgcccgcgtattatcggtcgtttctgaaatgttagacacattgatcaatcgaacaggagtgtagaccatgcgtatttccaattcaatcacctacaatgattttttacgaaatctaggaaccaacgcctccaaagtccaatccacgttgaatcagctatcgagcttgaaagaagtcagcaagtcctcggataatccactgctggtttcaaaaatcatggatcttaatgtgtcgttaaatcaaaacaaaacttacaacaatacgatcaaagacagtatttcttggacaaaagctcaagattctgctttagaaagtgttagtacctcgatgctgcggattcgctcgttggttcaatcttctgccaatgcaacagccggcagtgaggaattaggcgcaaatcgttcagagatcgagcaagagatcgaaggcatcgtggaatcattaaataccaactttgatggtcgctatctatttagcggaacgaatacgacgacggcgccttttgagatcgtcaaaaaaaatgacgccatcgtcggtatcaaatacaatggctctagcgaagacttgccccgagaaatcgcaaacggggtctcggtggatctgttagccagcggtgatcgtctgatgaacgagacgggtacagctgcggatccccaaaatttaagcacctacttcaatgatttattgtctgcgttgcgcagtgatgataaagatgcattagggggcgagcttttaaccgctcatgaccagcatgccactaatgtggtgaatgtacgggcgcagatcggcactctctacaatcgcttggaggcagcagctgatcgaaacgagacggaaaagctgaacttgaccgaaacactgtccaacaaacaagacgtcgatattgcggaaaagtatatggaatatcaaaatcaaatgactgcctatcgttcaacactagcgatgggaacaaaaatcatgcagatgtccattctagattacttaaattaacccgaaaacttttgttctttgctgagagcaaaagttttttatttttttttagaaaaaaggcttaatcctgaatggtttcttccgataaatagtagcagagggaaaccttagcgaataaaaattaggaggaactacacatgagaatcaatacaaacgtttcagcattgaatacttactcacgcctaacggcagccaacgcttctaaaagcaattctttgtctaaattatcttcaggcttacgcatcaacaaagctggggacgatgcagctggcttagcaatttctgaaaaaatgaaaggccaaatcggcggtttgtcacaagcaaaaagcaacgcacaagatggtatctcattgatccaaacagcagaaggtgcattaaatgaaacccacagcatcttagggcgtatgcgtgatcttgcggtacaaagttcaaacggtacgttaagtgatgacgaccgcagtgcgatcaacaaagaatacaccgcattgtctgatgaaatcgaccgtatcagggataccactgaattcaatacaaaaagcttgttaactggtgaaggcgatgatgcgaaatcattcactttccaaatcggtgccaacgcaaaccaaacaatgagcgtttcaatcacaaacatgagctcaactgccttgaaagtaaaaggcttagatttaacacaagcatttgccacaagcgatattgctgcagcaaaagataaagcagtagcggctgccttcaaagcagatacaacaacaaaatatgcagcggacggcaaagttgatgcggcagctggtaaaacagttgccgatttacaaacagccatcgatacagcagcggatgatgcagcaaaagcaacagctcaaaaaacatacgatgatgctttagcaacatttaccgcttctgatgaaggcaaagcagcagcagcagcagcggaaactgccatcgttgaaaacaacccaatcacaaaaatcgataaagcgatcaaagcagtttctgcacaacgtgcggatcttggtgcggcgcaaaaccgtctagaacacacaatcaacaacttaggtacaacgcaagaaaacctatctgaagcaaactcacgtatccgtgacgttgatatggcgcaagaaatgatgagctttacgaagagcaacatcctttctcaagcagcaacttcaatgttggcacaagcaaactcaatgcctaatagtgtattaagcttgttacaaggataattttttgatcagaggaactactgacacaaggactgcctaggggaagcacagttcttgtgttttacatagcagcacaaaaacgcttagaaatgaggaagctctgatggatattcagccaatttcaggaatacacccgatcgaagccgttgcgtcggtcgctaagacacggccgattgaagccgtagatcaagaggccaccaaccttcgctcgcaaagcaaagggcgtggattaacagaggaaaaggaacggacagtggcaactgaaccgccgatccactatttttcagcagccgatcagcacaagatcggagtctccgtggatgaagtgaatcagctgctactgggcaaagatatgaaattggcttatgaagtgcatgagcgcacggggcggacgatggtgcgtttggtggatatgcagaccaacgaagtcatcaaagagatcccacccgccaacatgctagatgtgattggaaaaatatgggatgacatggggatcgcggtcgatcgaaagggatgaaaatatggcaagtgtaaccagcagttcaggaatcagtacaacgctagggagttattctggcgtgacttcagaagatattgaaaaattattggcggcagatgcgatcaataagacccgcgctgagaacaaaatcacgtcgcttaaagcacaaaaaacggcgtggagtgatatcagcactcgcctgacgaactttttgtcaaaagtcgatgcattacaaaaagatgatgcttatcaaacgaaaaaagcgacgaccaccaatagcagtatcgcttcaattgcaggaacaacggaagccccagaaggtacctatgatttaaaaatcaaccaactagcaacagccacgaaggtgacggggagtcaagtagctcaaagcagcaaaacagctctaaatgtcagtggtcagctgtcattgaccagttcggaagtagatgaaaatggcaaaccgatcaccgcttcgatcgagatcactgctgaagacagcttaaaagatgtggcagctaagattaatagccaaagcaagacgaccttcgttgcggcgagtatcgtggataaccgcttgattttaacgaataccaaaatgggcgacaaaaatttcttgatcgacggcaatgccgccgaagggttagggatcggttcaactgcgacaacgacgcaaggccaaccggctatttttgagctagacggcatgaagatcactcgcgacagtaacagtgtgacggatgttatcgatggtgtcactctgacattagctaaaaaaagcgaggagcatgtgacgctttctttagccaatgatacctcgaaagtcgttgatgcagtgcaaggattagtggatcaatacaatagcttgatgagttttatcgatgataatttgaccgtgggagatcctagtagtgaaaacaacaagacggggaccttggtgggagacagtgcgttgacccgtctacagactcaattgcgaaatttgatcaccattccagccgtcagcggctcaaagctgaccgctagtaagctaggcatctccaccgtcgataatgatggtacattgggactggatacgacaaagttaaaagaagccctagcggaagatcccgctgctgtgaagtccttcttttatgcaagtacgaaaatcaaagaagccgatggcactgcgagtacgaaagagaccggctatacactagcgctaaaagaattagccaacagctatgtcgtcaatacttcagccaataaagggatcattgccaccaaatctgcgacctatgacagtaccatcaaggatttaaacaagcagatcacacggtttgatgatatattagcaatgaaaaaagagcgttacatcacaatgttcaccaaattagactccgtgatgatggaggctgaaaatcagctgagttacctaagcaatcagtttgccaatacgtcaaactaggcaagatatacgattaaagcagtcattttttcattcgcataagaaaccctcgtcaacaagaaaggaaacaatctatggagccacacgtatcattagatgaacgtttgaatcagatcttaactagttttgcaaaatggcatggcgacagcgaagaagccggtcgtttgatggcagccaatgcagtggtcatagaagccatgcaggcagaagaacagagccatagtccccaaaccagtgtattggcgcaacaagtgatccaagcgtatcaagtgttcttagaccaggtcaaagcccagcagcaagagatcaaacaagaattaggacgtttgaaccgcaaaaataatcttgtcaaaacgtatttgcagcaagaagacaatgccgccttcgtcgaatttgatttatagtgaggataaaaagatgaattatcagaaaatgcaaaacaactacttaaagaatcaagtgatgagcgcgtcacctaacaaattgattgaaatgcttttgcaggcagcaatcaagaatatcaaattggctcagttagcgattgaaaaacaagaactagcaaaagcccatgaacacttcataaaaacgcaaaatattttgttggagttgcgtacgtcgttagacgaaaaacaaggcggcgaaattgctgaaggtcttgcagcattgtatgaatacatgtatcagcagctgattgaagccaacatcaaaaaagaagtggttcctgcccaagcggttgcagaactgctgagcgagttattagaaagttggcaggccattacccaatcagcttgatcaaatctaccgtttgcttgctgatagacgaaaagcaagtatgtattaagcatatatagagaaaaaaacaacgaagtgctgtttttagccgctcaaagtcgtaaacctcgcgtttgcggcttttttattgcgttgatgcacttcgtaattgtactttgtaaaaagttatagaaggtgtattttttttgaagctgaatttagctttcattaggggacgcttcaataagggggcgcttcattaaatttttacaatgatacccttttcaaaaaggcttattttttaccttatacgacaattctgttattctaaaaaataagaactgttttgcaaggaggtcatttagtgaaaaaagcagttttattcaagccgacagttctgcaattgctcgttattttctgtgtaagcctgctgctattgttgccgcaattgtttggccgtggcttgattttaggttcggatgccgtctttcattttaatcgtttttatgagacgagccagcaaatcaaagaggggaactatcaatactttctttccatttatgggtttcagcaatctggacggatcgtcaatgcattgtatggtccattttttgcgtattttcaagggatattggttttgatcagccgttcctggttccagtaccaacttttatcgaatgggttgctataccttttggcaggaacgtccatgtacacgttgctgcgaaaattaaaagtctcaggctggttgtctgtggggatgggcattctttttatgacgacgtattcgatccaatattgggtcgaacgacaaggcttttcggcttggggggcagcaatattgcctttttgtttcattccattgatcgatatgacgcgctttcaacggattcgtccctttgctgtaggggtatcagtggctgcgctgtttcaaatccatgttttttctagtattttattggttttgatctatattccgttctttttgcgcacttttttgaaaagccaagataaaaagcggctcttgctccatttaactgctgcaattggcatttttcttctgctgactgccaatatttggctggcaatgcttgatctttatcaaagcaatcaattgttaccaccttttgtgaatcaccatatggaacgaaatacgattacgggcaccagcagttattggtggacatccccctaccttttcccattggtctgtgggttgttttttgccggctctttgaagaaatggcaagagatatccaatggcttgaagctgatgactgtcgttgcgggcatttttttcctattatcgtctaactatttgccatggcaatggttatctagtctcgaaaacccattgatagaattgattcaatttccttttcgcttttttgtccctgcgacagtgctgattcttgcgggattgtgtcttttgcggccctatttagcggatagccgcctgaatcggccgatttggctgattttacttttagttgtcagtgtgggtcagatcatgttccaaaccagtaccaagatgagtgagtggcagtccagcgattccgcggtgaaaatcagaaatcactcctatctgtttgtttctgatcagcagacgctgaaagcggcttatttcagtccagacaaggccaaggcactggtgctgttccagcggtcaacccccgattatgttcccatctatcgtgacacaaaggaaaataaatacgatgcctatggggaacaaatcatcaagcaaaacacgacagtgcaaaaagcagtggttaatggacagttgattttgcgctggcaaggggacgattctagctggaaggcattaccggtcatcaattaccagcgaacgaccttacagcttaacggccagccattgacgcgttccgacatcagagtgagtacgataggggcagtgactgttaagcagcaggcaggtctcaatgagctgatcgtggattatgacgcgccttggtattttgactggggactgtgggtgacaatggctgcatgggttttattggctcttggttttctttggaaaaagcggcagctgtttgctgcagttagacgccaaaaataatcaagggaacaaatgccgacggccgctttccgacagcaaagaataatgaattggcttagaggccagagaagcaactgtagtgggcaacactccagcacttctctggcgtctaagtttttttaagaaaaatttttttggaattagttgcgcccgcaaccaattatctttatactgaacctactgtatttaccttacggcatttaaaggagaaaaattatggagtcgatcattcgttcaatcaatcatattgcccgtttagcctcattgtaccgagaaagagagctaaaaaaatatgggttaggtcccatgcatcatacgtacattctaaatgtctgtcgcaaccctgggatcagtcaagaagctttaggtcagttgatttttgtcaataaaagcaacgttgctcgccaattagcagtcttagaagaaaaagggtatgttcgtcggcaaacgagcagtttggatgggcggcgacagcttatttatccaactgaaaaagccttggcgatgcaacctatcctccaacaattgttgaagcagtggaatgagcaagccttagcagggttttctgaaacggaacagcaaaaattgctggcagatctgcaagtagtaaaagaaaactcgcagcgtgctttaaagaaagaagatgaggtccagtgaagctactaaaaaaatacttgcgcccatatattgggcgtatgtctctcggaatcagtatcaagttttttgggtctttgatggatctgctgttgccatggatcctagcctatatcattgatacgatcattcctacaaaaaatgtttccgccatattcttgtggggcggtgtgatgctgctgtgttcggtgattgctgttgtaaccaatattttggccaatcgtatggcttccagtgttgccagagatgctactggcagcatacgtcatgatctttttgccaaagtagcctatttatcgattcctcagatcgaacaagtcggtatcccttcactggtttcacggttgactacggatacttacaatattcatcaaacggtaggcatgatccagcggcttggcattcgagcaccgatcctcttactaggaggcgtattgatcacagctactttagatccagtgctaacagtcgtattagttggagttttgcccttcacattagttgccgctgttatcatttcgaagcgaggaatcccattgtttgcgcaattgcaaaagcgagtagacacactagttcgcaccgtccgggaaaatgtgacaggtgctcgtgtgatcaaagcattgtcgaaagcagaatatgaaaaacaacgatttcagcgagtcaatcagtcagttgttgcggcagaaacaaaggcgaaccgaacgatggctgccacaccacctttaatggattttttcctgaatgcgggtttgacattggtgattttagtgagtgcctatcgagtgaatgcggggctgacacagccaggggtgattattgcttttctcacctactttacgatcattctcaatgcaatgttaagcatcacgcggatttttgtgatcgtttcgaaaggattagcttccgcagaccgtattcaagcggtactgcgactaccagaagacatgaaggtcgttccccttctggcaagagaagatgaggcacacattgtatttgaccacgtttcctttacttatcctgatggtacgaccgtcctgaaggaaatcgatttttctctagacaaaggacagacgttagggatcatcggagctaccggcagtggcaaatcgacgattgtacgtttactgctgcgcttgtacgatccgaccaatggtcagatccgcattaatggccgtgatatccgctcactggatcctgcagagctgcaccaatattttggcattgttttgcaaaaagatgtccttttcgcagatacgatcgaaaaaaatattgattttgggcgccgcttttcaaaagaacaaatcgaagaagctgctgctagagcgcaagcaaaggaatttatccagcagttgccgcaacaattggcctatgaacttcatgcgcgaggaagtaatctaagcggtggtcaaaagcaacgagtcctcctatcccgtgcattagctggtgaaccacaaattttagtcctggatgattcagccagtgcattggattatcagacagacgccaaactacgccaagtacttaaacaacaatttgcggacacaacgacgattttgattgcacaacgaatcggttcgatccagcatgcagataagattcttgtgttggaaaatggccgcatgagtggattcggcgatcatgccacattactggcgacgaataccatctatcaggaaatctatcatggacagacaggaggaagaatcaatgcctagcaagacagtcgccgaaaaaccaaaagagacgaaaaaaactgtgaagcgtctctggcactatttgtatgaagcgaaatggcttcttctattatcagcagttttaatgatggctagcaatctgttttccttagtaggtccactgctttccggttatgccattgatgccatccagccaggtccaggaaaagttgtttttcaccgagtattcttttattgcggatggatgattgctttttatctttgttcagcagtgttaagttatctgatctcattattgatgatccgtctgagtcaacgtgtcgtccagtccatgcgcaaagcgattttcaacaaaatttctgaattgccgatcggctactttgatcgtatccaaacaggcgatatcattagtcgaatcagttatgatgtcgatacgatcaatacatcattagctagtgatgccatccaagtgctgagtagcttagtcaccattattggttcgtttattatgatgttgctgatctctccagtgctcgttttgatttttgtagtgacagtgcctgcctcggttctattgactcgttatttaatgaagaaatttcagccattatttcggcgtcgttcgcgaaagctaggggaattgaacggatttgtagaagaaattctttcgggtcagcaaacgattaagatctataaccaagaagaaccgatcattgaacgatttgatgaaaaaaatcaggccgcagtttcctcttattacaatgcagaatattatggcagcatgacgggaccgtccatcaactttatcaacaatgtttcgttgtcactgatcagtgtctttggcgcactgctatttttattcggtcgtctctctttaggaagcgtctcctccttcgtgttgtactctcgtaaattttctggaccgatcaatgagctggccaatatctttagcgatttgcaatccgcgttggcagcagcagaacggatctttcgcttgttggatgaagaaccggaagtctccgatgttcctgatgcctatgagtttacagaagtaaccgggcgtatccaattggatcatgtctcctttgggtatcaaaaggatcgcatgatcattaaggacctatcgctggacgttgccccaggcagtttagtcgctatcgttggtccaaccggggcaggtaagaccacgatcgtgaatctcttaatgcgtttttatgatccggatcaaggagtgattcgtttagatggacaggacatcaaaaaagcgacgcgcagcagcttgcgcaaaagctatgcgatggtgctgcaggatacttggttatttactggaactgtctttgaaaacctggcttacggtaaagcatccgcgactcttgctgaggtagaggcagcggctaaagcagcccatgtccatgagttcattcaacaattgccaaaagggtatgacacactgatcacagaagatggtggcgggatttcgcaaggacaaaagcagcttttgaccattgctcgtgcgatgcttttggatgcggatctcttgattttagatgaagccacatcaaatgtcgatacccagaccgaggggttgatccaaacggcaatgactgagctgatgaagggcaaaacgtcctttgtgatcgctcatcgtctctccactatccgtcacgcagatgtgattttagtggtccaaaacggtaatatcgtcgaacaagggactcatgatgaattattagctagagcaggtgcgtatgcagccctttaccaagcacagtttgatgaataagcaacgaatagcttgactcagaagaagcagcttagcagttggactaaagacccacgcatagtagcagaattggggcatccaacagatagttgcgtctatgtgcgccgaaaacttgctgaatcgcagaagtacacaatgacacggttcgcagtttgtagcaggccttttgtcgccgcctcttctttttcaatcaagcagtgacaaaattatgcagcgtttccatgacaaaccgcttttttatcggtatacttagaaaggaaacattctgaattattgaaagaaagaagggaacctgtgtgtttcataaacaattaaaagatttccccaaagatttcttatggggctctgcgtctgcagcgtaccaagtcgaaggggcttggcaagaagatgggaaaggcgcctctgtatgggatgattttgtgcgcattcctggaaaaacatttaaaggaaccaacggtgatgtcgcagtcgatcactatcatcgattcaaagaagatgtggcattgatgaaagaacaagggctgaaaacctaccgcttttctgttgcttggacacgaatttttccagaaggccgaggagaagtcaatcaagcgggactagatttctacttggctttgatcgatgaactgcttgctgcagggatcgaaccaatggttacgctctatcattgggacttgcctaaagcgttacaagaagcttacggtggttgggaatctcgccaaatcattgaagattttactaattatgctgcgacacttttcgaagcatttcgcggcaaagtcaaatactgggtcagtctgaatgaacaaaatgtgtttacctcactaggctatttattagctgctcatccgccaggtgtcactgatcctaaacgaatgtatgaagtgaatcatattgccaacttagctaatgcttctgtaatcaatacatttcatgagatggagattccgggtaaaatcggacctagctttgcttacacaccaaactatccgatcaacagtgatcccaaaaatattttggcagcagaaaatgccgaagatttgatggcacattattggatggatgtctacctatggggcgaatatccgatcgcagccatgaatttcttgaaagaacaggggatcgcgccaacgattgagccaggagacatggaactgttgcgttcggcaaaaccggatttcttagggatcaattactatcaaaccgccactaacgcagcaaatccgttagatggtgtaggcgctggtaaaatgaatacaactggagaaaaaggcagttcagaagaaacaggaacacccggtatgttcaaaaaagtcgaaaatccatttgttgatcgcaccaattgggattgggaaattgatcctcaagggttgcgagtggcgttacgccgtatcaccagccgctatcggatcccggtgatgatcactgaaaatggacttggcgaatatgacaagttgacagacaatcatcagattcatgatcaataccgcatcgattatctgtcaagccatgttcacgcaatcaaagaagcaatcagtgatggtgcagaggtgctaggttactgtacttggtcgtttactgatttattaagctggttgaatggctaccaaaaacgttatggtttcgtttatatcgatcaagacgaaaatcaagacggtagtttgacccgttataaaaaagacagcttctattggtatcaagaagtgatcaagaccaatggacaaaatagttaaatcatagcaaaacaaaaagtacgtttctaaaaggaagcgtactttttttgtagaatgaaaatcgttgacaaatgtaaacgatggaggtaaagtagaagagtagagattacagttgtaatcaaaaggtagcctctctcgcttatttggggaacccagtacgatatttcattaaggaggaataaacaatggctgaagggaactatgcaatcgaaggaatgacctgtgcctcttgtgcccagacggtcgagaaggctgtcagcaaagtcacaggtatcgaagaagcctccgtcaatttggcaacggaaaaacttcacgttcgctacgatgaaacgcaggtagatgaacaactcttagcaaaaacagtagccgatgccggctactctcttataggaaatcagctgcaagcaacattccagattgaaggaatgacctgtgcttcttgtgcccagacggttgaaaaagccgtgaacaaacttgcaggcgttcaagcggctactgtcaatttagccacagaaaaattgacagttcattatgacaaggagcaactaaacacggctgccatcgaagcagcggtgacgaaagcaggctatcaagctttcaccgaaaaaactgttgagatgcaatcggcaaagaaagaccccattcaaaagttatggcaacgattttggttgtctgccatttttaccgtgccattattttatttagcaatgggcgaaatgatcggtctgccgctcccttcctttttgaaccctatgacacagcctgtagcatttgttagtacacaattgatccttgtgcttcctgtcatgatctttggccacgctttttttagcaatggcttcaaagcattgttcaaagggcatcctaatatggactctctggttgctttaggcaccagtgcggcttttttatatagtttgtatggaacggtcatggtttatttaggagagacgcatttcgcgatgcatttatactatgagtcggctgcagtgatcctaacattaatcacactagggaaataccttgaatcggtatcaaaaggcaagacctctgaagccatcaagaaattattggatttagcaccaaaaactgctcggatcttaaaaaatgattcagagatcgaagtgccagtcgagcaagtcgtggctggcgatattgtgattgttcgtcccggtgaaaaaattcctgtggacggacaactgatagtaggacattcagcagtggatgagtcaatgatcactggagagagccttccggtggagaaacaacctggtgattcagttgttggagcgagtatcaataaaacgggtacgtttcgctatcaggcgacaaaagttggcaaggataccactttagcacagatcatccagctagtggaagatgcccaaggttcgaaagccccaattgcacgattagctgacaaagtttcgggtgtttttgttccgatcgtgattggcttagcgttactagcaggactggcatggtttttcttcggacaagagtcgtggatctttgcactgacgatcactatttcggtattagtcattgcctgcccctgtgccttaggattagcaacaccaacggcaatcatggtgggaactgggaaaggcgccgagaatggtgtattgatcaaaagcggtgatgcattagaaacgactcgcaacatcacaacgatcgtttttgacaaaaccgggacgatcacagaagggaaaccagttgtgacagatcttttaccttatggcgaacatacgaaagaaacggtcttgcagctagcagcttctgcagaagatggatcggagcatccactgggagaagctatcgtagccgctgccaaacaacagaaattaacattttcttcagttagtcatttccaagccgtccctggtcatggaatcacgggaagattggatggaaaagacgtgctgttaggaaacaaaaagttgatggatcaaaaacaaatagatgtctcatctgtaattgcttctgccgaaggcttagcaaaacaagggaaaacaccaatgtatgttgccatggacggcgcattgattgggttgattgctgtggccgatacggtgaaaacaagcagcgcacaagccattgaacgtctgcatcaaatgggcatcaaagtggcgatgatcacaggagataatgcgcgaacagcacaagccattgctgatcaagtagggatcgatgaagtcattagtgatgtgttgccagaagataaggcggctaaagtggcagaactgcagcaaactggacaaaaagttgccatggtaggtgatggaatcaatgatgcaccagctttagccaaagcagacgtcggtatcgccattggctcaggaacggatgtcgccattgaatctgcagatatcgtgttgatgcgtagtgacttgatggatgtgccgactgcagtggaattgagtcgagcaaccatcaagaatatcaaagaaaatcttttctgggcatttgcttataatgttttggggattcctgttgctatggggttattgcatctttttggcggaccgcttttgaatccgatgattgcaggggcagccatgagttttagttctgtttccgtcttattgaatgcgctacgtttaaaacggttcactccagtcagtaaacgagcagcaagaaactaataataaaatagagaagaaagaaggatcattatgaaaaaaacatatcaagtcgagggcatgaaatgcgaaggctgtgcaaaaacggtacgagaaacacttgctcgagttgccggcgttaccgaagttacagttaatttgaacaagaaaactgcgaccgtcataagcgatgccccagagcaagcattgacagctgcgttaaaagacacttcttatcgtttactttctatctgatgaacgtcgagaagagagatataaaaacaatagaccaataaataaaaacagtcaaagcgagcagtaagcaagactaatacacccaaaaaccgaaaaatctcctttctatcttttggttgttcttttgtctagttttactgcgccgctttggctgtttattaccgttgaacgtctaaataggaatatacccgcgtatcataacggttgcgactgcgggagtattcgatcggtgagccatttttttggtaaacgatttgttgaatttctaatactggatcggttggatcgcaagccagatatttctgatcatataacgagcttttatccgcagaaatcgtccgataagcaccgacaaattgaatgcctagttcttcttttacatactgatagatagaagtttccaagtgagaacgttttagattaggaactaaatggaccggcatgtacgtatgctctagaataaatggtctgccttctaaaattcgcagacggataatcttatagacaggttgttcttctgtcaacatcagtttttcttgaatctctttgtccgggaaagctacttgaaaatcaatgacttcactggtcaattgccgctttgctttgcgcatttcagtggataagccgacatattccgttaatgtagtcgtatctcgatccacaaaaggatgattcaatattttagttccagctcctcgctgagaatagacgagcccttccatagagagaatcccgatcgcctttttgatggtcatacggcttacttgaaactcttcaacgagatctatttggttaggtaataaactatctggaggataggttttattcttgattctggttcttaaaatattggcaatttcttgatattttggcatctcctcacctcgcaaagagtatagctgaaaaaagcgatttcgacaatccgaatcggcagccttttttcaaaataaaagactgacaggttgatgggcctgccagtctttttgtcttaactgattgaagcttcttgttgacgatccagaatacgcaagaatggataccagatcataccgacaagtaccacgtcaatgacttgcagcaagccccctaaccaagaattggttgctaatacaccgctagcaatcactggcacggtccaaggcacagacacaccagttggtgctggaactagcccagcagccatcaccaagtaattgaaggttgttacaactaagggtgcgactacccaaggaatcaaaatcgtcgcattcaacacgatcggcattccaaaaatagcaggttcattgacattgaagataccaggagcaagagccaagcggccaacatcacggtattgctttttcttaaggacaaaagccatcaaaatcacaacagctagtgtcattccagaaccccctaaaccaaccgtgaaagtttccatgaatggtttcgtcacgatatggggtaatgcttcgccattttgataggcttctaaattatccaacatcaatgtgttccagataggatccatgacagagttgacaatgatttgcccatgaagaccaaagaaccataagaactgaaccaagaacagtgccaatagtgtagcaggtaagctgctgccaagacctgttaacggtttttgaatcaattcatagattacatcatgaaggttcgcatggaagacgccggtcatgatcgcattgatcatcaaaaagatggttagcgtaacgatcgctggaatcaaagcagcaaatgacttcgttactgcaggtggcaccccatcaggcattttgatttgccaaccgcgttttgtgacgcgacaataaatctcagcagctaagaaggcagcgatcattccgataaacatccctttggcgcctaatcggtcaagggaaagcacgccagttactgtttcgcctgattctgtagtcatgaaaaatggcgttagaatcaaaaagcttgcaaaagatacagcgccaccaaaaatcccttcaacatcataagacttagacaaataatagccgataccgaaagtaacaaaaactgtcatgatgctcattgttgcattttgtccattaccgaacagggtacttagagtgcctttcgttgcatcattgaaaaaaggcagattgttgataaccactacgattgaaccaaacatcgtaatgggaaaagaaagcatgaacgcatctcgtaatacagtgaggtagcggttttgccctaacgcattggctagcggcaagattttttcagatattttatccataaaaccgttcattaaaaatcactcctaacaactttttgcaatcgattacaattcataatgtatcatgttttattttaaatgtctatacattgtctaataaaaagattgatttttggtagtgcttcctttatgattacggtatcaagcatgaataaggagtgtaaaaaagatgacgtatcaatttccagaaggattctggtggggttctgctgccagcggtcctcagacagaaggaacttttccaggagacaaaaaaggacccagtatttgggattactggtatgagcaagaaccaggaaaattctttgaccgtgtaggccccgaaaaaacatcccaagtctataagcggtataaagaagatattcaactgatgaaagaaacaggacacaatacatttcggacatcgatccagtggagtcgcttgattccagcaggaactggcgaagttaatcaagaagctgtggctttttatcatgattatttcgatgaattgattgcaaatgggattgaacctttcgtcaacttgtatcattttgatatgccgatggccttgcaggaaaaaggcggttggttaagtcgtgagacagttgaggcttacgtcgtttttgccaaaacttgttttgaattgtttggtacaaaagtcaaaaagtggttcacgcataatgaaccaatcgttccgatagaaggtggctatctctatcagttccactatccaaacgaaatcaacatgaagcatgctgttcaagccggcttccatgaaaccttagcgagcgcgaaagcaatcaaggaatatcatgcgctagaattgggtggagagatagggattatcttgaatctgacacctagctatccgagagatgaagcaaacccggaggatgttaaagcagcccaaatcgccgatgccttcttcaaccgttcttttctggatccagcagttaaagggacatttcctgaagaattagtcacgatcatcaaagaattagacatgataccggaacatgaagcagaagatttagtgatcatccaagaaaatacgattgacttattaggcatcaattactatcagccacgtcgtattatggcaaaagaaacaccgatcgaccacacgaatggcccattaccagatgattattttgacaattatgataaacctgacaaaaaaatgaacccttatcgtggatgggaaatctatgaaaaagggatttatgatattttgaccaatacccgcgagaattatggcaatatcaaatgctatatttctgaaaatggtatgggcgtagaaggagaagaacgttttgtcaatgatgaaggaatcattgaggacgattatcgcatcgaattcgtcaaggaacatttgaaatatgtccaccaagcaatccaagaggggaccaattgtgttggctaccatatgtggacatgtatggataactggtcctggacgaatgcctacaagaatcgttatggcttcatttctgttgacttgaataatgatgccaagcgcactattaaaaaatctggccgttggtacaaagaagtttctgacaataacggcttttgattcaaaacacagtgaagattgcttcactgtgttttttttattgtcaaaaaatggtgctgtctatagcaaaagaataggactgtataatccatgctcagttttataaataaaaagactagacttataaatgtaagcgtggtttcctatagaggaaatcggtttcactaaattataggatggtttttgaaaggagaaaaaaatgaataagtttatcgcgtttatggagaagcattttattcctattgcttccaaaatcggttcacaacgtcatctagttgcgattcgtgacggttttatcgtaacgatgccattgatgatcttgggatcttttggggtattgatcaataatttgcctattccagcttatattgattttatgaacggtatttttggtgaaggcacctggcaagcatttggcaataatttatctgcaggtacattttctattttagctttattgattgcattcacagtttcttataacttggccaagagctatgaccaagatgcattaggagcaggagcaatttcagttgccagcttttttgcattaggtgcaatggccacagatgctgatggtttgctgacagctgcgggtcttggttcacaaggattatttttggcattgatcgttgctattatttctactgagatcttccgtcgtttggcaggcaatcctcgtctagtgatcaacatgcctgatggtgtaccacctgcagtttctcgttcttttgcagcgttgttcccagcaatgatcactgtttcgatctttgcattgttcacagcaatcttccaagcattcggcgtatcaagtttggttctatctttctatgagcttgtgcaacaaccattcatgggattggcaaactcttatccagctgcattgctactagggttcatttctgctttcctttggttctttggtttgcatggtgcaaatatcatcgatccatttatgcaaacgattaacattccagctatcgaagcgaatacgaaagcgcttgaagcaggagacaaattgccgtatattgtaaataagccgttttttgattcatttgttaatataggtggtaccggtgcaacattaggcttattgatcgcaattttcttggttgctcgtcatcataaagcctatatgactgtagcgaaattatcattggctccaggggtatttatgatcaatgaaccagtgatgtttggattgccagtcgtgttgaatccaattttgttcatcccttatgttttgacaccacttgtattagtttcaactgcatattttgccacagcaacaggactggtaccagcatgtaccgttattgcgccttggacaacaccaccgatcattggtgggatcttgtcaacacaaagcattgctggcggaatcttagctgcagttaatttgattatctcgatcgtgatctatcttccattcgtgaagatggcacagatccaagaaaatcgtcgtctgaaagaaatctaaccgatcaaaattaggctgggacataagtcagaacaagacgaaactacccgaacgaatgaaaatgacaatcctgttgctttagttgctagttggtggctaaagcaacaggatgggtagtcgtctttgttgcttatgccgcagtcttttttaattaataggatgtgaggtgaatgttgtgccaaagtatgttgagatagcagatgtccttcgaaaaagaatcaaagatggaacttatcccaaagagagctttctgccgcatcaaacggagttagtaaaagaatttggtgtcagtcggatgaccattaagaatgccatcaatattttgatcatggagggactgttgctttcgaaacgaggatctgggacgaaagtgttgaaccattctttttgggatcgtgacacgtcttctgtaaacgaatacaaaggacttagttaccagatgaaaatgcaaaaaagagatttacaaagtcaggtaattaccttcgaagtctgtttcccagatagcagagtacaagagatgttgaaagtcgctgcggaagagccggtgtatcatgtgattcgtttgcgaatattagatgggcaaccttatattttggaacattcgtttatgccagtagatttagtgacgggattaacgaaagaaatcttgcatcgatcggtatatgattatttgttagaagagttgaattataagtttgccggtgcttatcgaacatttcaagcagcgaaaagtgatgagtatgatcgtcaatatttgaagtgtcaatcggatgatccagttttggaattagagcagattatttatttagaatcgggaagaccgatcgattattcaagaagccgaaatcggtatgatgttcgcgggtattccatgttagacatgaaaccagatcttttaaatcatcgaaaaccataacgaccaaagtgctcgctgctttggtttttttgtttttgatggccgaatggtttgttttcgtatagattctgagaatcaggtatactaatagtacgaagatagatacaagcagttttcaatgattgcttaaggagtgaagaaaagtatgaacctgctgtttgcgattgacgatacgtttgtagaacaattaaaaacaaccctctattcaatttggttgcacacatcggcaagccgattggatgcatttgttttacaagagaaggaacttgctcagacagagaaattgaatcaattttgtcatggactgggaattgtctaccatccagtcattatcggtacaggatctatttttaaacaagcccctgtcagtgatcgttatccagagtcgatctattaccggttattggcccaaaattatttgccgaaagatctagataaggtcttatatttagacgcagacatattgtgtatcaacgatttgcagccgctatatgaattaccgcttgaagatcatctttatgcggcagcaaaccattcaaaattaacagaggttacgacagtcatcaataaagtgcgtctcaaaaattatgagtctgaaggatatttcaattcgggcgttttgctgatgaatctgactcagttacgtcaagaagtaaaagaaaaagagattgcggcatttattcagaagaatcaattgaatttatttttaccggatcaagatattctaaatgggctgtatggggatcggatcttgggaattccagaccaactatataattatgatgtaagaaaaaaccgtacatatgaaacgatcagcctaggacactgggacttagactgggtcatcgatcatactgtattgctgcatttttgtggtaaagacaagccttggaagaaagggtacaagagccgttatggttcgctttataaatatgttgcccaacaacaaagcaagtatagcaggtcgttatcagacaactagagctgaaatcgaccaacgatctctttgagacgagcattacttttttgaaatgaaggtaggaatgataccataatattagaaactaaggcaaaagcagcaaaccgttgctagattcatttaaccgagtagcggaagaaaagtggagaacgaaagggagcgatagaaatgaaatttttgctttggcttgtttgtgtggtaggaatcgagattactgggattatttccagcttgttcgcgggtgatattgctgcgacgtatgcccaaatggacaaaccgtttttggcacctccaggagggattattggtatcgtttggacgattttatatgcctttatggggacagctttgtttttactcatcattgcgaaagtaaatccagcatttaagaaacaagcctatatcttctttggtatccagcaagtgttgaactttttgtggagtattgtcttttttggctggaatctttattgggtaggaacagtggttatcgtcttattggttttgacagtcatcgtctgtatgtttttatttgcccgaatcgataaaagatccacctatctttttgtaccttatctgatttggtgtctctatgcggggtatttaactatcggattaacactattaaatagttgatagtaacaaaaaacaagcgcagatttctgcgcttgttttttgttataaatattcttctgtcaactccatgaaggtatcgatatcttgtaagacccgatcgattccggcttgccagaaatcaggttttgtcagatcaacgcctaaatgtttttgggccaattcttccgtcggcatagaagctgtgtcttgtaacaaagcaatatattcttcttcaaaactcgtccctttttggttggcataagcatagattcccatgctgaaaagatagccaaatgtgtaaggaaagttatagaaaggaacatcatcaataaagaaatgtagttttgccgcccagaaatgtgggtgatagctagctaatccatcggcgtaactttctttttgtgcagccaccatcatttctgtgatttgttcagcagaaaccagccctttttgccgtgcttggtaaaaactgttttcaaaaataaagcgggcatggatattcatgaacatggcaatggcattttgcattttggcatctaacaaattgattttttcttcttttgtttttgcttctttcaatgttgcatcagcaacgattagttcggcaaaggtacttgcagtttcagccacattcatcgcataatcctgattaagctgcggcaagtcccaaagaacactactatggaaagcatgacctaactcatgcgccaaagtggctacctcattgacggaattactataagtcatgaaaatacgtgattctcttgtttcaggcagacttgtacaataaccgccaggacgtttgccaggacgatcttctgcttcgatccaacttttttcaaaggcttcttgcgcaaaatcagccattttgggactgaattttttaaagttttctaaaatgaaagcagctgcttcatcgaatgtataggtacgttccttcatttcacctaaaatgatcggagcatcttgatcctgccactccattttttcttttccgaataattgggcttttcgtgtcaaaaagtccacgatcggttgtttgttcttctggatcgttccccacattgcgtctaatgtcgctttttgcaggcgattatactcgagaggctccttcagatagtcatctacaccgtgcagtttgtaattggagagacggaatccatccagatgattcaatgtatcggcaaataaatcttctttttctccccaagctttttcccactccgcaaatagttgagcacgaacttcaggatctgggtcacccatcattttgttgaaagcttgaccagctgaaagagtaatcgttgttccatccgaccgggtaaatggaatcgcaatcgaagcaacaatcgtatcataatgctgactccaagcatttagtccgtctaaagaaagtgtgttaataatcgtttcttctgcttccgacaaaagctccttgccgtcgcgacgaatttcgctcaaacgaaaggcgatagtcgcaaagggttcttctttcaatagtgtctcccagtcttcatcagaaatttctgtcaattttttcgaaaaaactgtttcggctgcttgtagcattggtaatttggcatagagatcgcccgaaagtaattttgcctgattgtcattaacgttggcagatagcaatgcattgataaagctgctgcactgagaaaatcctttactgattgtttcggacaatgataataattcagctaattcctctggttgagaggcattgtcgggttgccacgcatctacttttgtgcgataagttttgatttgtgcatctagttgggacattcgttcttgcagttgggtagacgtgctgccgcctgaaaaaatcgaatcaaggtcccagttgagagaataagtcatcttgggtgttgctcctttcgtttatcagatggtaataagtatagcacacccttcgaaaagtagttgcagagaatactgaaaatggtaagattagaaaatgaggggctgagatgatgaaaaaaatgtggaaagaaccaaatttttatttcacgattgcggtagctgtgatggtgattttatttattagttcgtcacaaacttatgaacaacaatcacaagtcggtttgctttctcgcctgttaaaagaagagccattgaaagaatggttgagcaaattcgctttctcttatgcaggatctgaaatcagtattgccgaaaaaggttatttttcttttgtggaattttttattcgtaaaggggctcatttctttacttactttgtattaggaggtagcttatttctatcattgagctatcgaaaaattccctattggctgtcagctttctttggctggttggcagcaacagggtatgcagggatggatgagtaccatcaaatgttgaccggtggccgtacacctttgttccaagatgtcatgctcgattcagctggagcactgacagctgtcttacttagttgggggattcttagttggcaaaagcgaggcaagaaaagaaaataagattattttttaacagcaaccataactaaaatgcaatcaatcagctagaaatagtaaagtaaagatagaggcggaaaagatgcaagcagatcacagcagtaaaataaatgatccgaatagacgacaaccggatatcgtggtgcatgaaagtctaccagtaggagttgccttagcaatggcagggggattcttagacgcatatacttatctctttcatggagaagtgtttgccagtatgcaatcaggaaatgtcattttgttaggaatcaatttggcatctggagagtttggacaggctgccagatatttaccgccaattttgctgtttttgatagggatcatagtgactaatggcttgcagcatcgtttcccaacaggtggtagaattgtttggcaaaatgtagccctcttctttgaagcacttggtatttttcttttaggattttttgctcagacattgccaaatgtctttgtggattctggactttctttttttgcagccatccaatatgcttcttatcgcagattagctggaatgccctatgcaacgacgatgacgaccggaaatttgcgttcaatggcggattatctttatcagcgtttcttcaaaaaagatgctactgtagattataagatcaagtatatcgcgatgatcatcggaggatttttcttcggggcagtcagcagcagtttattaggtatgtttctttttcaccgaacgatttgggtcgtatcgggcatattactttttgtactgacgattacgatcagaaaccagaatcgggtataaaaaaggacggagaaataattctccgtcctttttggattatatagattaaataacgataacaggcgttcctacttctaccataccaaataattctttcatcacacctggcggagtattgacacatccgtgagacccgcgggtcttccataaatcaccaccatattctggttgccaatctgaatcatgaatcccaacgccagtccaatcaataggcatccagtagtcaacaggagaagaataatcttcgccggtcaatgtagcattccgctctttgttccaaacgtaaaatacacctgtaggagtgggtgatttaggttttccagaaatgatgtctgtttcaagagcgactgcaccgtctttgtaataccacatatgttgattttttaaatcaacttcgatataagtgtttccaaacagtggaccacttggatctgcactacccaagaccactggagaacgagtaaagtcttctccagtctttaaggcttcgatcaatgcacttgtttcagaatcagtttggatcgtccaacttagtgtcccagctggtacggatacctcgccttgtttcgtgcttttgaacgtagaagcattggtgcttgtgttgtattggttccctaaatctgctacataattccgtactttttcttcatcaatcgtggtttttccatctttataagagagccaatccatgattgttgcggtcggaatctggaaagttgagccattgatggaataattagcatttacttgagcaattttattcaatgattccatttcttttgctagttctttgtcatcagaagtaacgctaggtttcttttgatacgcagtcaaatccaattcactttcgccgctagtaattgctttttgtaattccgtgacagtttgttcgacgtcaatggcatcaccaacaacttctggctcaatcgagaatccatcatctccttttttcaatgtggcatctttagaagcggtccgaccttcatttaaggtttctaaagcctctttgattgtggctgtttcacttgtcaacttttgttgatcaacagaaacggtacctagttttttatcttctgcagcagatacataggccattccccatgtccactggttttgttcatctttcaaatcttccaattcttttgtaaaatccgtttgcaaaccaaattgagccaaattgatggttttccaatccgtattgccttctttgattgtaaaagactgtttgctgtaacggtcatgcaacaaatcattggcttcagcgaccgttttattgctgatgtcaatatcatcgatcgaggtatttggcaagaaacggtcttgataatatgtacttcgataagcgtatccgcccgcaatcacgactagaacggcagcgatagcgatcagaacgatctttttcgtcttactctgagtatgtgtgtgtttgttggatcgtgtcatttaaaggctccttttatgatgatttaaaaatgatagatcggctaaatcataccatattctacaagaaaagcgaattgattaagtgaaagttccatgaaaaaatagagaattcttaaattataaaaagagtctgctcataggacagcaaccaagaagtgattcaacgaaagctgctgtgtgataaaagcacagcagctttacgcaatattctttggatcaaagtacacgaagcatcttgattcaaaggatctctttcttgttcggtcttatgttacagactcttgtaagtggcttatagcaatcgttttattgattgtcttccgcatctagtttcgcaaaagcttcatctagaatgtctttcaattgttttgcagaagcagtcattcgatcttgttctccatccgtcaatggaatttcgattactttttggattccttgggcattaatgatagcaggggcaccgatataaatatcttttaagccgtattcgccattcataaagacagaaagcggcagtactgcattttcatcatccaaaatggcacgagtaatacgagccaaggcaacagcgataccatagaaagtagcaccttttttctcaatgattgtgtaagctgcatcacgaacactgaagaacaagttaaccattgcttcttcatcaatatcggggttgtttttgacccattcataaatttgcaatccggcaacatttgcatgagaccaaactgggaattctgaatcgccatgttcccctaaaatataagcatggacattacgtgcatcaacatcgatcaactcagctaatgcttgacggaaacgagcagaatctagtgaagttcctgaaccgattacgcgctcttttggaaaacctgagaatttccatgttgagtaggtaagaatatctactggatttgcagcgacaaggaagataccgttaaatcctgaatcaacgatttgtgtaactacttcacgattgatttttaagtttttgtggactagatccaagcgagtttcgccaggtttttgtggcgcaccagctgtgatcaccacgacatcggcgtcatgtgcatctgcataagtggcagcatagatttttttgggtgaggtaaatgctaacgcatgagataagtcgatagcatctccttctgtttttgctgtatttatatcaatgatccctacttcttgagcaatattttgagtgactaacgcaaatgcataactggaaccaaccgcaccgtctccaacaaggattatcttttggtgatcttttttatttgtcttagcagtcatttgtgtatcattccttccgcatatttgttttactaggtaacatcctaacactttcaagcgattttgtcatgtgatttgctcaacaatgttacagataattttgctgtttcatttgtaaatgctttctttgttatcctgtaggaattaggataaatcagggtttctaatgatttttttaagaaagagaaattctgagcaaaggaaagacacggtaacagtccgttatgtgttataatcgtagtgaacgtttttactgggcagaattgtcgtgcccagtattttgtggtggtaatttttttgaaaaaatggagcggatcaaaaaatgaaaatgattataggtctgggaaatccaggcaaaaaatacgaaaaaacaaaacacaatgttgggtttatggtagtcgatgcgttagcggagaaataccaagctacttttaaatcatcagcttttgaagcagaaattgctgaattttttatgaacggtgaaaaaatcatgttggtcaaacctcagactttcatgaatgaatcgggccgggcagtagggcctttaatgacttattatggagtttatcctgaagagatcgtggttatctatgatgatcttgatttagcgttaggcaaaattcgtttgcggcaaaaaggcagtgcgggggggcataacgggatgaaaagcttgatttcccatcttggtacatctgtatttgatcgcatcaaagtagggatcgatcgaccacagccaggccggacagtggtcgatcacgttctaagtccttttgctaaagaagaccagccgatgattctgcaaagcttggataaagcagcagcagcaagtatcgattacttgaccaccggtgattttcttgccacaatgaatcgatttaattaaggaggacctgtatggatctgattgaactaataaataaggtgccgcaagtcgctgcctggcaccaacaattaacggatcacgcatctcgacagctattgactggcttagcaggttccgcaaaaacattagcttttgccggagcttatcagaaatttgatcggcaagtcattgttgttacaccaaatctttattataccaatcaagttgccgaagatttgcggaatattattgacgacgtgtatgtctttccggtggatgaagtgttgtcggccgaaatggcgtttgcttcaccagaagctcgagcggagcgagtgacagcattgaatgctgtcgctaccgggaaaaaaggaatttacgtcatgccgatcgctgcattgcggaaatatctgcctgctaaagatacttggctgaactaccaattttcttggcatgtgggggatgagatcaatttagatcagttgccgcagcaattggtattgatggggtatgagcggcaatcaatgattggcaaacctggtgaatttagtattcgtggaagcattttggatatttatcctttgaaagctgaatatccggtgcggatcgagcttttcgatgtggagatcgactcgatgcgctcttttgacgtggaaacacagcgttcagtagaaacgttgtcagaagtaacgattgttcccacaacagaattagtgttttcgccagctgatttagctcatggacaaaaagttctgcaagagttgctgaagaaacggctcgctgtagtgaaagagaccacagataaaaactttttagaagattattttggtcaattagcatcggcttggcaaagtggcatacctgacgagaatgctcgttattatgcggatcttttgtatcagcaaccgacgagcattttggattatttttcaaaagatgcactgctgatgatcgatgattatgctcgtattatggagacaaaccgcgagattgaacgagaagaagctgagtggcatacacaaaaaattgcagaacttcgcgttttttctgagcaatctttcgggcaagatgtccagcagctgattcaaaaagaacaattttctacaagtttcttctcgctttttcaaaaggggatgggaaatcttcgttttcaagcgatccacaattttcaatatcgaccaatgcaacaatttttcagccaaatgggtttgctgaaagttgaagtagatcgctgggagaaacaacaacaaacggttgtctttttagtaagtgattcagaacgagcaaaaaaattggaacaagattttcgtgatcactccatttacgcagtacaaaccacagcagatcgactttttacaggtcgaacgcaaatcgttgtagaaacactgcaaagcgggtttgaaatgccccaagataagttggtcattgtcacagaaaaggaaatcttccaaaaaatcaacaagaaacgtacgcggcgtcaaaatgtgaccaatgcggagcgattgaagagttacaatgaattaaaagccggcgactatgtcgtccatgcgaatcacgggattggtaaatacattggtatggaaacgctggaagtagatggtgtacaccaagactatatgaccatcctctaccaaaatgatgataagctgtttattccagttacccagttgaatctgattcaaaaatatgttgcctctgaatctaaaacgccaaagatcaataaattaggcggcagtgagtgggcgaaaacgaaacgaaaagtttcagcaaaaatcgaggacattgcagatgatctcattcttttatacgcaaaacgcgaatcggagaaaggttacgcgtttcagcctgatgatggctatcaaaaagaatttgaagatgcctttccttactctgagacagatgatcaattacgcagcactgcggagatcaaacgtgatatggaaaaagaaaaaccaatggatcgcttattagtcggagacgttggctttgggaagacagaagtggcattgcgggcggctttcaaggccatcaaagagagtaagcaagtagcctttctggtgccgacaacgattttagcacaacagcattatgaaacaatgctggatcgctttgaagggtttccagtcaatgtcggtttgttaagccgttttcgaacgaagaaacagcaaacggaaacgatcgagcaagtgaaaaagggccaaattgatattttagttggcacgcatcgcctgctgtctaaagatgtagagtttgcagatctgggattattggtgatcgatgaggaacagcgttttggcgtcaaacacaaagagcgcttgaaacaattacgctcgcaagtcgatgttcttacattgacggctaccccgattccccggacactgcatatgtccatgttgggggtgcgggatctttctgtgattgaaacgccaccggaaaatcgctatcctattcaaacttatgtgatggaaatgaatccaggtgcagttcgagaagctattttgcgggagatggcacggggaggacaagttttttatctctataatcgagtagatacgattgaacgtaaagtcgaagagctccaagcgttagttccagatgcgcgtattgggtatgcccatgggcagatgacagaaatccagctagaaaacacattgtttgattttatcgaaggacaatacgatgtgttggtgacaaccacgatcatcgaaactggggtcgacattccgaacgccaatacattatttgtagaaaatgcggattacatgggcttgtctactctttatcaattgcgaggtcgtgtcggtcgaagcaatcgtgttgcgtatgcttattttatgtacgaacagcaaaaaattttgaacgaagtcagtgaaaagcggctccaggcaatcaaagactttacggaattaggttccggatttaaaatcgcgatgcgtgatctttcgattcgaggtgcaggaaatctcttgggggcgcaacagcacggatttattgatgctgttgggtttgatatgtactctcaaatgctgtcagaatccgtagcgcgtaaacaagggaaaaatacacaagcggagaaaacaacggttgagatcgatcttggcatcgatgcgtatctgccaacttcttatatagaagatgaacggcaaaaaattgaaatttataaacgcatccgtgaattggattctcaagaagcggtggatgagctgcaggatgatctgcttgatcgctttggagaatatccggtcgaagtggctcacctattaactgtcggagaaatcaaaatgaatggggatcgggcattgttagatacgatccgtaaacagcagcaaacagtgatcctaacgttaagtaaagttggcaccaaaaactattctgtcgaacagctgtttgaagcgttgaaagcgaccaagcttaaagcgacgatgggtgtcgatcacgagcagatgacgatcaaacttcagattcctgctgtgatgaaagaaagcacttggctgttagagattcaagattttgtcaaagcgctacgggaacaaaaatacgtgttacaagaaaattagttataaaggggcggagaagatgccaaagtcacaattaaaacggacgatggaaggagcatttattttaacgattgcttctttcattgccaaagtgttaagtgcggtttgccgcgtccctttccaaaacttagttggtgacgaagggttttacgtctatcagcaagtctatccaatctatggattagctatgacattggctttatctgggttgccgcaatttatttcgcgcgtgatcgccgaacaacctgatcctcagaagcagcgtgcccagatccaagtcatctatccgtatgttttttggacagcgattggactatgggcaacgacgtttttctttgccgatgttatcgctcgggtcatgggagacgcaggactggcatctttgatccgcgtggtatcctttacattcctctttgtaccacccctgactttttatcgtgggagtttccaaggaaatttacagatggtaccgacggcagtttcccaagtagtagaacagctccttcgagtcggagtgattttagtagcggccagtttttttcatctcttctcatgggatgtttatcagactgggactttggcaatgtccggcgcattgattggcggacttgcggcgtgggggattttaagctattatagtcggaaaatcaccggtcggtcgttagcgatccccacaaaaactatgcctaccgcacatgctccttccttgcgtcgccgttttttgattgaagggggactgttgaccatttacagcggttttttgattttgtttcagttggcagattcctttttgatgacgaactcacttgaagccagcggtttgacggaacaaagtgcccgcattgcaaaagggatctatgaccgaggacagccattggttcagttaggtctcgtggtagcgatggctctaagttcgactttcttgccaacattgacgaaatatctgacagtcaaaaatcagcacttgtttgaaaaatcagctaagatgtacttgcggttgactttagggattgccagtgcttctgcagttggcttggctatcctgcttccttatatcaacttcgctctttttaaagatggtgccggcaacagtgcgttggtcttatttgtttttgcggtcgctttgatggctgcaatccaagcgtatcaaagcatccaacaaagccggaaccaattccgtgtagggatttatgcagcaggatgcggccttttgcttaaaggtttgctgacgtggcccttgacctatcttttaggaacaactggtgcgagtttgagtacccttttaggtttgatcggtactttaatctattttgtgttttctgagaaaaaagcattgaacagcttttggatagagcaagggtatggcaaaaaactcctgctttgtttagggatcatggcttgcgcactgtttttatattatggtgtgatcactctgttgagtggaggtccagtgacgaaaagactgcaagcgctgattttttgccttggaggggtcttttttggcgggacagttttcattataatggctctcaaagttaaattattaacgattcgagaatggctgctcgttccgtttggaaaaaaattgttgaaattaagaggtggaaaaaatgagattagataaatttttaaaaatatcccggattatcaaacgtagatctgttgcaaaagaagtagcagataaagggcgtatccaaatcaatggaaaattggcaaaatccagcagtgatatcaaagtcggcgatacggtgcgtattcagtttggaaataaagtattagaaataaaagtacaagaattacacgaatcaactaaaaaagaagatgcagctaaaatgtacgagatcctcaaagaagaacgtatctcagaaaatgcttgatttttgtcccattttcagttagacaacttttgtggatgttggtataatggaaaaaacaatcacagtgacaggagcgaggtcagcatggataaagagccaaacaaacaaatagaactattgcagaccgagtatgccaaagagcaatttgccaagttcgaaaaagaacgacgacaagtggtctttcgtcgacgtcgacttgtagctgtttttgttgcagcgctagtgatttttgcaatcgtaggtattcaaatgttcaatgatcaaatgcgtctgcaaaaattacaagagtataaagcagaaacagtagcaaaacaagaagcagcggacaaaaaagtgacacaacttaagcgagatgtagcactgttgcaagatgacgaatacgttgcaaaattagctcgcagtagattcttttattcaaagaaaaatgaaaagatctaccctgtcttgccggatgcttctgattcaaaaacagaaacaagcggtgatgaggcaaatgctagtgatacaaagacaagtgattcggaataaacaaggtcatacctactcatcgcagtagttgaaatgattaaatgggtaaaaattaggaggaacattttttatatgtcaatcgaagttggagcgaaactaaagggcaaagtgtctggtattacaaattttggtgcgttcattgatcttggtgaggggaaaactggtttggtacatatcagtgaagtatcaaatgggtttgtgaaagacattcatgacgtgttgtctattggcgatgaagtaaccgttgttgtgacggcaatcggcaatgatggaaaaatcgggctatcgatccgtaaagcagaagcaaagccggaagaaaaacgtgattttcctaaaaaagaattcaatcggtcaagtccgaagaaatctttttcacgcaatcaaccgacgaacgtaaataaacaagacttcgattcattgatgagttcttttctaaaagatagtgatgatcgtttatcttcattacgacgtaatacggaaggtaaacgcggcggccgtggcggtcgacgtaactaaacaggatgagcaagttgtcaaaagaatttgtgacgtaacgataagtatttcaaaaaatatccgaactatatccgattactcctaccatgtagtaggctttcgccgtggagcacggcgttttggaatcggcatagttcggatatttctctttcttagcaatagacagtcatttttagtttgaagttaagtatagaagcaagagacacggagggatagaatgcttaagcaaaaagtctatcatgcaatcaaagccgatggatgggtagaggatgctacttgtttgcttgctgtttcgacaggcgtggattcaatggttttactccatgtgatcgaagagttgtttcagcaaggaacatttggcgtggctcatgtcaatcataatctgcgggaagcttcagacgacgaagcagcgttcctgaaggactattgtcaaacgcgcgggattccatattatgaacgagtttggcaagatccgccccaaaatggcatcgaagcggccgctagagagttccgctatcatttttttgcagaaacgatgactcttcagagttatgattggttattaaccgctcatcatgcagatgaccagatggaaacgatgctgatgaagatggtgcgagagggacgcttgcaaaacgcttcgggaatcaagcgcaagcaaccttttggtaacggttatttgatccgtcccttcctaacgatcgccaaagaggagattagagactatgcaagaaggagagggatcgcttatttcgaagatgaaacgaatcagcaaacgctgtttcaaagaaatcgcctgcgtcatcaagcggtccctctgctgaaagcagagaacccgagagctcttgatcattttcagcagctttctcaagagatgatctatgctgaccaattgatcaaaaagcagcaagcagattggctcgccacgatacttcatgaggaagctgaaggctattttttaaacttggatgaattggctgcgtttaccgcagcagaacgctattacttttttgaaggtttgctacagaaagtttcccatgataaaggaatctcgtacaatactaaacaacgagagcagttgctgtatctactagaacataatcccagtcagtggataatcgatttaaatcaagattggcagattgttcgagtttatgatcagttgaaagtcactgctgttaaaaaaggctctcacctccaaacgcaggtagatgagacgcattttgttctaaaaaaaggtgaaagtttctttttgtcggaccatgaatggatcggctacattccaagtgacgcccaagttccagaaaaagtcatggattggtcagagatttcacaaattttaccgatacaatatcctgcgacagtttttttgcggaagcgaaaaccaggggatcggttacagctgaaaccaggtcttacgaaaaaaatcaggcgtttctttatcgatgagaagatttcgaatgaaaagcgtgctgctagttgggtcctgacagacgctcaagagaatgtattggcacttttgccttatctattttcctatttgagtattgagcaagaaactgataaaatacactacatacttctttataaatatcggaagtaagagttggaaggagaactttatgttagacaaagatattgaaaaaattttgattactcgagaagagatccaaaatcgttgttctgaactaggtaaagaactgacggaaatctacaaagataaaaatccattggtcgttggcgtattaaaaggagctgttccttttatggcagacatcgtccgagaaatggactgtcatttggaattggactttatggatgtttctagttatggaaacgcgacaatttcttctggcgaagtgaagattttgaaagatttggatacaaatgtcgaaggccgagatatgctgatcgtagaagatattattgatagcggtcgcacattagcctatctagtagacctatttaaatatcgcaaagcaaagtcggttaaaatcgtgacattgctagacaaaccagaaggacgtgtggtgaaaatcgatgccgactatattggctttgatgtaccgaacgaatttgtggtcggctatggattggattacgcggaacaataccgtaacctcccttatgtgggtgtcttaaaaccaagcgtttatcaatcaaattagtgactgatctaaatcagttgtgatacaattaaatggtcaggattgataaaacaaaatagccaaggaggtacgcatgaataagaaaaataacggtatgatcaaaaataccttatattatgtacttgtcttgttagcaatggtcatggtcgtctatttcatttttggaaatggcaatcagcaaacgccaacaatcgagtactcaacatttacggagcagctgaaagacggaaaggtcaaacagtttaccgttcagcctgctaacggtgtttaccggatcgtcggtgaatacaatgccgaacaaaccgtcagcaatgacaatgggctttccgtactaggaagcacgcaagcaagtacgacacgttttacaacgatcattttgccgaatgactcgacattgagcgaggttacgacattagcaaaggatcaaggggttaaaacaacgatcgaagaagaatcgaacagtggtgtttggttatcgttgctgattagtttcttgccaatcgtaatcatcattttcttcttctatatgatgatgagccagcaaggcggcggtggcggcggtggcggccgtgtcatgaactttggaaaatccaaagcgaaagaggccgacaaaaaagccaatcgcgttcgtttctctgatgtagcgggtgctgaagaagagaaacaagaattagtcgaagtggtcgaatttttgaaagatccacgacgctttgtcgaattaggtgcgagaatcccagctggtgtgctgctagaaggacctccagggacagggaaaacattgctagcaaaagcggttgccggagaagctggcgttccgttttactctatctcaggctcagactttgtggaaatgtttgtcggagtcggagcgagccgtgtccgggatctatttgaaacagccaagaaaaacgcaccggccatcatctttatcgatgaaatcgatgcggttgggcgccaacgtggtgccggcatgggtggtggacatgatgaacgtgagcaaacgttgaatcagttattagttgaaatggatggatttgatggcaatgaaggagttattgttattgcagcaaccaaccgttccgacgtgttagacccagccttgttacgtccaggtcgttttgaccgacaaattcttgttggccgtccggatgttaaaggccgtgaagctattttacgagttcacgcacggaacaaaccgttgtcggatgatgtggatttgaaagtcgtagcacaacaaacacctggttttgccggtgctgatttagagaatgtcttaaatgaagctgcgctagtcgctgctcgtcgcaataaaaagaaaatcgatgcctctgatattgatgaagcagaagatcgggtaatcgcaggacctgcgaagaaagatcgtgtcatcaataaaaaagaacgcgaaatggttgcttaccatgaagcgggtcatacgatcgtcggtttagtcttaagccgtgcgcgggtcgttcacaaagtaacgatcatccctcggggccgtgctggcggttacatgatcgcattacctaaagaagatcaattcttaatgacgaaagaagatatgtttgaacaaatcgtcggattgcttggtggacggacagcagaagaaatcattttcggcgttcaatcaaccggagcatccaatgactttgaacaagcaacagctttagctagaagtatggtcacagaatatggtatgagcgacaaactaggtccagttcagtatgaaggcaatcatcaggtcttcgtcggtcgtgattatggtcaaaccaaagcttactcagaacaagttgctttcgagatcgatcaggaagtacgccgtatcttgatggaggcacatcaaaaagcacatgagatcatcgaagaacatcgtgcgcaacataaattgattgccgaaaaactgcttgaatatgaaacattggatgcaaaagcaatcaagtcattgtttgaagaaggcaaaatgcctgctggaactgagaattcagaatatccaagcgaaaaagctcaaacttttgaagaagcaaaacgcgctttagaagagaaagatgctgaaaagcaagctgctgagaaaaaagattttgatcagcaagtagacgaacttcgtcacaataatgaaaaccacgaagcttcatctcaagataaaacagaggacggtcaagagtagtcgttcaattatcaataggtgattagctatcgtaaagtctagggactgtgtcataagtcaaaacaagagaacagattcgaatgaggttcggaccagttgcttgttttacggcttgtgccgcagtcctttcttgttaacaaatcgagaaataaaccgacagaaaacattggcttttctctaaaatggtggcattcagttgaaaaaaaaacaagttcctagtatgattcactaatgaacgaaataaaggagcataaacaatggaagattacttagtaaaagcattagcttatgatggttttgttcgtgcctatgcagtgtctgcaacaaaaactgttagtgaagcacaacaacgtcatgatacttggaatacagcatcagcagcgctaggccgcgctatggttggaagcctgcttttgggcagcacgttaaagggtgatgacaaattaacggtcaaaatccaagggaacggacccgctggagcaatcattattgatagcaatggtcgtggagatgtcaaagggtacataaaaaatccgcatgtcagcttgccgctaaacggacaaggaaagttggatgtgcgaggagcagtaggagatcaaggaatctttactgtaatcaaagatttagggttgaaagaaccgttttctggacaaacacctattgtctctggagaattgggagaagacttcacttattacttagcagtttctgaacaaatcccttcggccgttggattgagtgtgttagttgataccgatgattctattcgaacagccggtggtttcttactgcagatcatgccgggagcagatgaaacggttattgattcaatcgagaaccgcctgcaagaattaccacgagtgtcatcattgctggatgaagggaaatcgcctgaagaaattttgacggtattgttgaatgacaccaaagtcgaagtgttagaaaaaatgcctgttcaatttcgatgtgattgtagcaaagaaaaatttgcgacagcgatcattacattaggcgcggatgaaatacaagaaatgatggatgaagatcatggtgcagaagctgtttgttcattctgcggtaataaataccatttcgatgaacaagaacttgctagattaaagaaagaagctgaggcatagaagatggcgatacacagctggaaaatcggtaatgtcgaaatccctaatcgagttgtcgttgcgcctatggcaggaataaccaatgcggcgtttcgcgtaacggtcaaagaatttggcgcaggcttagtcgtttgtgaaatgatcagtgattggggaatccaactacgaaacaaaaaaacattagaaatgctttatatagatgaaacagaacatcctttaagcttgcaaatttttggtgggaataaagagtctttggtcgaagcggctcaatttgtctcagaaaatacagcagcagatatcattgacatcaatatgggttgtccggtaaataaaattattaaagcggaggctggtgcaaagtggctattggatccagacaaagtctacgaaatggtgcatgcagtagctacggcaattgataaaccggtcacagtcaaaatgcggatcggttgggatgatgaacatattttcgctgtccaaaatgcgcaagctgctgaagcggcaggtgcagcggcgattgggatgcatggccgcacgagggtccaaatgtatgaaggagcggctaattggtcggtattaagagaggtgaagcaagcaatttcgatcccttttatggggaacggagatgttcggacaccagaagatgccaaacgaatgctggaagaagtcggcgcagatgctgtcatgatcggacgagcagcattggggaatccgtggatgatccatcgtacaaaacattatcttgaaacgggagagctgatcgccgaacctactccacgggagaagatcgctacagccaaacttcatttggaaaggcttgctgatttaaaaggtgaatttgttgcttcccgagagtttcggcagcatgctgcctactatttaaaaggcatttcacgggcagctaaagtcaaagcggcaatcaaccagacagagaataagcaagcgattattgatctgttagatgcatttgtagaaaagacagaaaaacaacctgtcggaaatactcctgagtaaagtaaaatcaagtcgatcttgaacttcggcttgattttttgtggcatcattggcattataagaaggaaacccaagttaagaatggaggaaaactcgtgacagaggaacgacaaaaacaagaagaattaaatgatcaaatgttggttcgccgtgaaaagatggaaaaattacgggaagaaggcattgatccctttggcaagcgctttgaacgtacgcataattctgccgagttgcatgagttatttgatcaacgaacaaaagaagagttaacagagatgaatctttctgcaagtgttgctggacgaatggtgacgaaacgtggtaaagggaaagctggctttgcacatttgcaagatcgtgatggtcagattcaaatttatgtccgcaaagatcaagtaggtgacgaaccgtatgaaggatttaagcatgctgacttaggtgatttctttggtgtctcaggggagatcatgaaaactgatacgggggaagtaacgatcaaagcaaaagaaatcgttattttgtctaaagcgttacgcccactcccggacaaataccatggacttaccaacatcgagcaacgttaccgtcaacgttatctggatttgatcagtaataaagatagctttgaccgattcatgaaacgcagccagatcatcagtgagattcgtcgctatttggatggtcatggctacattgaagtggaaacgcctgttttgcataatcaagcgggtggggcagcagctcgtccatttatcactcatcacaatgcgttagatattgatctatatttgcgaatcgcgcttgagttgcacttgaaacgattgatcgtaggtggtatggagaaagtctacgaaatcggccgggtcttccgtaatgaggggattgatactacccataatccagaatttactatgttagaagcttatacagcctatacagatttcaaagatgttatggatctaactgagggaattatccgcaatgcagcagagaaagttttagattctgctgtgattacttatgatggacaagaagtcgacttggcgagtgattttgcccgcgtgcatatggtcgatgctatcaaacaacaaacgggtgtcgatttttggaaagagatgacaatcgaagaagcacatgctttagcaaaagaacaccaagtggaagtcactccaacgatgacagtaggacatgttatcaatgaattctttgaaacgtttgttgaagaaaccttacagcaaccgacctttgtttatggacatccggtagaagtctcacctctagcgaagaagaatccaaaggaccctcgatttacagatcgttttgaactatttatcgtaggccgggagtttgctaatgcttttaccgaattaaatgatccaattgatcaaagacaacggtttgaagcacaagaaaaagaacgacaagaaggaaacgatgaagctcatggagtcgatgaagacttccttgaagcgctagaatacggcatgccgccaaccggtggtttagggatcgggatcgatcgtctagtcatgctgttgacagatgcacaatcgattcgcgatgtgctgttattcccaacaatgcgttgataattcataaagagagacacacgggtgtttacttgtgtgtttctttttttaccagtagttccctccaaaatgactaacaagaaaaaaacaagggagaaactcactgctaaatggaacgaaaacgaattaaaaacgaacgatgaattcattggattgtaagaatgaacgcctttgagaaattacgaaaataagagagaaagttattgacctgacagcatttagttggtatattattacatgtgccaaatgacaaaaatcatttctaaaagaaaatgaaaaaagttattgacgccagaaccaacagatgatattataacgaagtcacaaatttaagaaatcaatttgatgctgatgcagcaacaaaaaagattgaaaaaagttgttgacaaataacaattcatttgttattctaatggagtcgctgatgacgcacaggaagttgttgaataaacactttcgaaaaaaacttttaaaaaaagagttgacattcgcttgttaatctgatatgatttaaaagttgctaacgcagcgcagtagacctttgaaaactgaacaaagcaagcaaacgaaccaatgtgtagggcgcttcattatatgaagcaaaatacatgcaagcaatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttctgcatggaagaaagttgaaaggcgcttttgcgtcactgatggatggacccgcggtgcattagctagttggtgaggtaacggctcaccaaggccacgaggcatcgccgacgtgagggggggctcggcccnnnnnnnnnnnngttatgcggggtgaggttactccgctccctccggtcgcctagtactgttcatcatctgctcgggtctttgaccaatcgcagtgattcacagcaaaaaggcgtcctcaagcaagccagttatggcttgcttgaggacgcctttttgcgtgttaccacctcagtttaagctatattcacatatagctcctcttcgagtacgatcatactctagcaagataacggatgctgccgtcgccgccttgcatcattgctcgggacgaatcactccttggccattttccaaaattcgtttcctgcttcttttcagctaccgaagctctctgtttaggaacattccttttgtacttaccaattcatcgtgttgactctatttttttatgccgctttttattttcaaagatcgatgaaaacaaaaaaagtccttttaccagcatctgctgataaaaggacgatcactcgtgttaccaccttttgttcagaaggtttcccttccctcaacccaacgtctatcaagaaaattccatcaagagattggtgctccttttaacggtagagcagattccgtgattgcctacttatcgacaatcaatcctccaaggccatttttcaacgtttcagacttaactctttccaccaaccagagtctctctttaaagtatctacgattactttccttatcaacggatagttattcttgttgaaatgtactttaccggaaaaaggataccttgtcaatcagaaaactattttttttcagaattttttggcaatgctagaatctgggcatagcgatcttgccagatccgctcataccaatgaatgatttcagcagctgaccagccttcgaatgcataagtagtcgttgcttgctgatacaacacattctgataccctaatccatgggcaaatttgatcgtgccatccatacaaaattcagtttgcgcaccgatccattcgatgctgcgaacatggtgctttgtcaacaaggactgtaaggaggtattgaaaaagctattcgcatgagtcttgcgcaaaaacaagtcggttgcttgcacagccaaatctggatgtaagagccattcatctgtttggtagccgagttcttcttcctcatgctgcacaaataaaacggggcgttgtgcatgacggtaagtttggatccgctggttggcaaacaacagcagcgaatcgagatgatccagtttggtgccattgtttgaacacacgcctttttgtaaatcaacgatgatcagaatatcttgcatccacttctcctttagttttggtataagattcctttatcagccaacaattgctttgcttgctctaactctgctgcttcttggtagcgtaacgtatggagatggatcccattggtcaaatcagaaagcaggcgggcttgtgaatgctggtatttccgcataaagtctgcgacatcttgttccgttttgatccgcagattccctgttaattccccataaatctcatgctcaacgatcacatcaatcacttcgattccgcaagagacaaatgtcaacaattcttcttctgtttgttccggacggtgttgcacagcaagtttgctgacatgacctgtctcacttgcagcttctaagcggtaaccgcgagcggtagccacgatagcctctcctgctgctcgcaacaaggcaatgtcaccaacgatgatttggcggctgacacctaacttacccgctaatttactagcactgatcggtttctcggcggtctgcaactgcttgatgattgcttcccgtcgtgttgctccatccatcattatccctccaattgattcttttgataagtgcgagaatgttccatgatcgactcaaaggttacgacaatcgtttcttcgaaggctttattggaaacggactggcgaacattgttcaaaacagcttcttcccgagattcatccagaactgctgtctgttcctgttttttccattggacgatttcactgactgctgtcatgcgtttttctaataattctgtcagttctcgatcaatcgcatcgatcgtctcccgttgatgatcgatagcagcaacgacttctgtcgtgcttttagttgcgggagcgacatcttttgcgatctcttcgatggtttcaccagattcaatggttttgatgatccgagctggatttccagcgatcaccacgttatcagggaacgatttagtcacgacacttcccgcaccaacgaccacgttatcgcctaagcgaacacctggaaggataactgcaccgccaccgatccaagcattgtcgccaactgtaattggtgcgccatactcaaggccactattacgcttgactggatgcaatggatgagaagctgtaaagagacgaacatttggtgctagcatacagttatcaccaaaggtaatgggacaaacatctaaaaagatacaatcataattggcatagaaattttttccaactgaaatattatagccgtaatcaaagcggacattcggttcgatatagatacggccagccacttgaccaaatgtctcttttagcagttgttctttgatcatcggttcggattcccgattgatcaagtgcatttgttctctggcaaatttgcgatcggcaactaattctggatctggtgaaaaatacaattcaccagcaatcattttttctttttctgtacgttctgtcataatgtgcctccatactccttttcaattttagtgtgagagttttgcaaaaactgtttccccacttgctaaaacttgaggagtcgtattttgttcaagcattgtttggttgatgatcaagcaattctggctattttgatactgcaacaaaccagcaaaaggatagacttgtaatgaggtgcctaccacgaccactagctgtgcattggccacagcgttgatagctgcagtaattgtttcttcgctgaaaccttcttcatacaagacgatcgctggacgaatctgtccaccgcaatcggcatgatgccagtctgtcaaataggtttgccaaggaacttctgcaccgcattgacggcagtaacagcggtaaagggttccgtggaaatcaatacgctgctgactccccgcctgttgatggaggccatcaatgttttgcgagactacccaaacgttccgttcttgagcgaactctgccatcgtctgatggatcacattgggctttgcttcaggatggtagagatgtttgacaaattgataaaatttatccggctctctgaccatacaagtatgactcaacagatattctggcgcttcaatgccatgataaatccctttcaaagagcggtaatccggaataccggaaggggttgaaacgcccgctcctgtcaaaaaagtgatagactcggcagcttgaatcttttcgacagctgtttcaatcgatactaacattttgctgaactccttccgtgattgttctactttttaatagtatacctaatttccccattttttataaccatcatccgcgatttttcacaaaccttcccttgaaaaagcctcaacaggaaggaaatcttcacttggaattttcagctcatttcattgattctttcatgacattctacaaaaaacgtggtaaactattcacgaatcaaagtgaggtgaaatacattggtagcatctattatttattgggcaatgatcatcatcagtttcggctggttggcagttagcttatacttctctattttctatttatctcgtaaagaaaatggaaatctatgggcgtttgctttcttaaatgtcatcacagcaatcattcaagcactcgttctattggtttatcgtacattaggtcaagactggggcgttacacaatactcaagtctcatttatttagctctaggcttattactaggtctgacagttattcaagctgtcttaggccgcgaaccaaaagccaaagttgcttaaagtagccgaaagtaaagaaaagcagttcccttttccaaagaaaagagactgctttttttgttgaaaagaattgacaaatccacctttttcttctacactcgattaagtatcataatcaaatacgagtatcctttaacatttaggtagaggtcgcgaggttcattaatcctgctgagtgaagcaacacgtcaaaagcagagctagggaacatcgccgaaacaaactgattcttgcttgaattattttgttgggacgcaagtgaacaacttgcgtactgtcttagcttggctaagttgcgctatgttttgtgaaaggtttgtcgacgaaattgtcaacagccgttttccaatcatggagtacggctgtttttttgttacctttgcctgtctgtagtgccactcgtgaaaggaaagagaaaatgaagaaaatgaattggttttgggcatttttcgccctctgtttcacacttgtcaatgtatcgatgactgctcatgcagatgatcaaactccagctgatcagtttcgagtggggatggaagcgggttatgcccctttcaactggacccaaaccaccgatgcccatggagcggtacctatttctggcgagaaagggtctgcctatgctggcggttatgacgttcaaatcgcgaagaaaatcgctgatggtcttggcaaagaattagtgatcgtcaaaacacaatgggatggcctggcacctgcattacaatcagggaccattgatgcggtaatcgctgggatgtcccctacagccgaacgacgggaacaaatcgattttaccgatccttactacgaatcgaacttagtcgttgtcgttcaaaaagatggtaaattcgcaaatgcgaaaagtttagctgatttgacaggtgcaaaaatcaccgcccaattaaatacattccattacacagtgatcgatcaaattccagaagtacaaaaagaacaagccatgaaagatttttcttccatgcgcgtcgcgttggcttcaggcatcattgacgggtacgtcagcgaacgtcctgaaggcgtcactgctacaggggcaaatcctgatctgaagatgatcgaatttgccgaaggtcaaggttttgaaaccaacccagaggatgtccaagttgccgttggtatgcgcaaaggtgaccccgatgtccaaaaggtcaacgagattctagcgacgatccctcaaagtgaacgcacgaaactcatggatgcggctatcgaagagcagcctgcggacaccagcggagattcagcgaatcaaggtctgctggccgatttcaaaaaaatcatcgatgactatggttctctatttttacgaggggcaggattgacgcttttcattgcgatcgtttctactgtcgtcggattattgattggtctattagtcggtgtctttcggacgctgccagctgctgaaaatcctgtaagtcgctttttccaaaaattgatcaatgcattattgacgatctatattgaagttttccgtggcacaccaatgatggtacaagctatggtcattttttatgggactgctctagcatttggtgtttccatgaatcgtacgattgcggcattattgatcgtttctatcaatacaggagcctatatgtctgaaatcgtccgtggcgggatctttgcagtggatgatggtcaatttgaagcagcacaagcaattggaatgactcactggcaaacgatgttcaaagttgtcttgccacaagttatgcgaaatatcttaccagcaacaggtaacgaaatcatcatcaatatcaaagatactgccgtgttgagcgtaatcagtgtcgccgatcttttcttccaaggaacatcggctgccggaacaaattatcaatacttccaaacatttgcgatcatcggtgcaatctatctcgttttgacaatctctgcgactcaaattttacgttttgttgaacgcaaaatggatggtcctagttcttatgtcaaactagaagatatcaacccagaataaggaggaagacagatgtcagcaattatcgaaatcgatcatttaaagaaaagttttggcgacaatgtcgttttgaaagacattagtctttcggtcaataaaggtgaagtcgtaacgattatcggctcctccggttcagggaaatccacactgcttcggtgtatcaatcttttagaaaagccaaccagtggaaaaatcatttatatgggcgaaaatgtcctagaaaaaggatacagcttaccaaactatcggactcatttagggatggtgttccagtccttcaacctttttaataacatggatgttctggaaaattgtgtcacgggccaagtcactgttctaaaaagaaatcgcgccgaagcagaaaaaattgctcgggagaatttggaaaaagtcggcatgagccgctacgtcaaagcaaaaccggctcaattatctggtggacaaaagcaacgggtagccattgcccgggcattgtcaatggatcctgatgtgatgttattcgatgaaccaacttcagctcttgatccagagatggtcggagaagttttgaaaacgatgaatgcgttagctcatactgggctgactatggtcatcgtgacccatgagatgggctttgctaaagaagtctctgaccgagtgatcttcatggacaaaggtgtgatcgctgaagaaggcacaccagaagaaatctttatccatccaaaagaacagcggacgaaagaatttctatcgcgggtacttaattgatcctgtgctgaactagggtacaagttgcagacaaaatgatttagacgaacagtcagtgccttcctgtcttacaagagggcattgcttgtccttaccgaatcatcttcttgtcgcttgttccctggtttctttttttggccttggtcaactaagagttgctatttgatcatttttttgttattttttttaaaactagagaactataggagtaagttgatatgaagaaaaagttacgtattcaagactatttgtatgttggttctatgttgtttggtctattttttggtgcgggaaatttgattttcccagtgcatatgggacaagaagctggtagtaatgtagcccttgccaatttaggtttcttagtgaccggaattgggttaccattcttaggcgttatcgcatttggtctttcccaaagtacgggtgtcttcgaattagcttcacggatcaaccgccgttatgccattattttcactgtgttgctttatttagtgattggtcctttttttgcactccctcggttagccacaacttcctttgagatcggacttgtaccctttgtttcccaagatctccaagcacccttgttggccgtattttcactattattctttggggctgcgtggtggttctcacgcaagcctagtaagatattggattacgtaggaaaattcttgaatcccctctttttggtattgcttggcttacttttagtctttgcttttacgcagccaatgggtacaatccaagaggcgcctgtttctccgctttaccaagaacacgccttcttcaccggcttcacaaatgggtacaatacgttggatgcactagcctcattagcctttggcatcattattgtgactgcgatccgtaacatgggtatcacgaaaccttccgaaatcgcgaaagatacgattctttctggctctatcagtatctttctgatggggatcatctacacattgctttcctacatgggagcgatgagcctaggaaaatttgcgatcagtgccaatggtgggatcgctttagcacaagtagccaaccattacttaggccgctctggaagtctgctcttagcattgatcgtcattttagcttgtttgaaaactgcgatcggattgatcaccgcatttgccgaaacctttgcagaattgtttcctgcaagaagctacttgtttttcagtgctgttgccagcattctaccggcgatctttgcaaatatcggtctgacgaaaatcattgagttttcaactcctgttctgatgtttgtctatccgctggccattacattgattttgttggcgattattagtccattgttccagcatcgtgccagtgtgtaccgtatgaccacttatttcaccctggtggcagccgttattgacggattaaatgcttgcccggcattgattagagacactgctgtcgttcagcagttattgaaatttgcagagcaatacttgccgttcttcaaaatcggcatgggttggctggcacctgcaatcatcggtttcatcataggtctcgtttgggcttggtgcaaaaaagaaccgaaatccgtcaaaaatcattaattcaaaaaaaatgacctaccatttttgaaaggtaggccattttttttgataaaagactgacagttgaaacaaaaacaggtacaatagacccattaaaggaggatatttatgttttacgaagaacttatgatggatccgcaaacgttgatcaaatttaaattattccggcgcatgcttactttacaaaatccaaatcatccaatcgcgcaattagccaaagaaatggacttgagctatcagcaaacattcattgagttgactgagatcgatcaagatttacacgagttgaccccggatcacttgtcaatacttggacgtggtggcaagctgcagccccaaaatattgcggcaacgattgatgagtaccggttttatcttttgaacaagagcgtaccattcttatatgttctttatatgctgaatgaagaaaatcctaccattacggatttttgcaagaaatatgatgtcagccgttcaacagtatcccgaaaattcgaacatctaaaaaaccatttgaagcagtttcaattgcgttttacttatacagaatcgaatctcgttggcgacgagcgcttagtgcgtctttccttattcaatatcatttggttaggcgtccgggggatcaaatggccttttgccgtttctgagtctgatgcagaagctttcgtcgatgagtttgctagctattttcctatctctcgttcttatctagggaagctagagttaaaatattttgctgcgttggtccttttacgcattagaaaagcgaattttgcaaaatacgaccgccgttataattttttgatgaaaaacaatcgctattatgatttcaatcgcttgcgtaccacgttgactgccgatactgaattaacagaaaaacagcttaaaggagaatcaagttttatctatttgctctcccaaatgctacccttctacttgtctgaggaagatccttccttgcaacaaacattgacattctatacgactaaacagaatccgatctatccgttagtttttgatttccttgcccaaatgaaacagacctattttgctggacagcaggaacttttagatgatcctatcttgattggtaatctaatcaatgcgacctttggcaactacgtctttcgacaaccgtttcctaatatttaccggctgctcaccctttccatgggacatggtctgccacaggaacaattgcatcagcatatcgatcaattctttaccgactatcgctcttccaataatgtagactatatcaatgacaccaatcaagaacagttagcagcgatgtttactcacgtcttgttaccattctatgataagatccgctacgccaatcggctgcatgtcggtgtcgttttggaagacaactttttacttgtccaatccttgaatcaatttctgcaagatctgacctttgtgcaagcggatccttatgatccgcaattgaaggaaccctatgatttagtgattagttccaatcaattgatgaaaaaaatgaacccaacgatggcaacttatctatgggattatgcagctgctgatgctcaatacatcgatctttatcgtacgttgaaaaaatacttcaatgaaaaaaatcagcacgtgtaaccgaatcgttatcttttcttaagaacttccgaaaacttttgtcacagaatattcatatttagttagtatagtataagcataccaacaaacaaccctaacactttttcatttttaactccttcccgccggccacccaccggcgggtaattttttgtctctttttctctagaaagcaatctttaaaactttccaagcttttctccacaaaaaattcacatttgccgactatagtataagcataccaacaaacaaccctaactaacacttttcatttttaactcctagcctgtcagccacccactgacaggctcctttttttgtaaaattcctttctgtagtacaatcaatacaaaaaggggagctttatgacaaacaccattgaaacggttgatcagtatattgctggctttccggatcattccactgtattgcaggaggtccgaaatttgatcaaaacagtcctgccggatgccgaagagcggattcgttatcagatgccaacctatttccaaacagagaatatcgtccactttgcctgtgcaaaagagcacataggattttatccaacaccctctgccattcttgcttttgaaaaagaatggcagtcttataagaccagtaaaggaacaatccgtttttcgtttacagaacctattccttatgatttgattgctcgaataaccgcttggcgtttgcaagaagttttagcgaaaacaactaccgattaactaaaaaagtgtaacaaaaaagtctgtgagtgtaataaaacaacgtcctaagatcagcttgattgcttcttccgcctacatggctgctatctgctgttttggtctcttgttttacttacgtcacagactttttttacttttcgggccgcgttgctttgacctttaatgtgctgacctttaaaacgctggctaaagggatcatacgaatttgttgccgatcactttgcagtttcaaaacgacttgttctttcgcaaccgtttttccaacgatccaaccggtaacggtttcaaaactgccaaccttctcggttttcacttgtaagacgaccagatgtttgtcactggccgctttttgcaaaatttgccgaatctcattgatcttttcagtttgattttttttatcggcattgtcactgaagaaagtatccaacaaggttgtcgaagtcatgacaatcaacttgcccagctgtctgatgggagatgatttcttttccattggtctttcctttctgctaacagcagcgggtttctctaaaaccgcacatacgttctcgtttattgcttttattttaacaaattttgaggaaaaaacaagcgaacattccctttattgggcagcattttttattttttctatccaaaggggcagtcctgcttgaatcaagcggtatgtttggttgaaatctcctgtgtaataaggatctggaatatcttctccctctccaggaacgacacttaagtacgtgtaaagcttatgctgcatacctgctggagccattgctgaaaggtcctcataattgttacgatccatgccaatgatccagtcataggtttcaaaatcctcagaagtgatcttgcgggaaaccatgttctgccaagaaatccccgcatctgctaatagttgacgagttccttgatgaggcggattacccgcttcccatgaactagtggctgctgaatcgatctgccaaggcaattgacgttctgctattgcttgcttgaaaagcccttctgccatcggtgaacgacaaatatttcctaaacagacaaataaaactttcgtcatgattattgctcctctttttgataaatttgataagaaaaaaattccacatcttttgccaagcgaaagagttgggtcgcgatttctaatggcatttccggaaaatcatcacgaatccaagtttctaagattccactacagccataagaaaagaaacggctgtaaaaagcaatgtcttgttgcgacaattgttgctcttcatcgacttcatcaaacaagcgctgaaataaaggctccgtaatttgataaaactcactcatcagaatatcccggtcataagtaacagatttccgatagaaggttccgttttgccgcatcgccttcaacattttcaaagctgcttcttcccaattgtctagcgaaatgttttcagatgttagataaatcagcgcatctgttttgtagatccaacgaatcaatgcttttttatcggggaaatgataataaaaggtttgtcgattgatctgcgccttctcagccagctcttgaatgctgattttgtttaattcttttgtctcacaaagttcaacgaatgtttgaccaatgactgctttggtttgattcccttctgccatggtacacctctttttcaaattctctccttatcataccaaatttccaactaaaaaagtattcttgcagaaaaaatcccagctatttcactagctgggatcaaaaaaagagctgaaaacaatttcagctctttttttaataatgcaatccttcacgtcccaatcggttgggtgaacttatttctcaaatttttttttcaaaaattctctgcggatgcccacgactttctcggtaaagttgacccaatccactggacgcggcggcgccagccacaaaatatgattgatccccattgccccataaaaaggcatgtttgaaagagtcagatgagtcttttcatcaggaaaactttgaaactgaatattcaaatcgagaatcttttcaatattgttgcgaatcatttgattatacgaacgaccataagaaaaatcgacacatacatagagaggaacagatatttcttttaatgggatcgttgagatcaataaaatcagatagcgaaagaatagaaattccttgttgttccacaaaatgggtcggttccggttagcttcaaggtaattccgacaaaaagccacatattcagggtatgtttgcaggaaataagtgacgtccaaatgttgatactcgcatcgcgaactgaaagaaaatgaaagcagttggtaatgaatgttcgtcaattcagttgtaagcagtgctagaagctcttgggaaagagcaaaacgaccactaagttctgtatagaaatgttcatttaattgggtgatataatgattttgatcaatgtagcggtcattttctactaaccagccttctacgatcagaaaccgcaatatctcctttgcttcccgctctaaggtagtcaggctcaccgtaggcaagatcttcgccagccagtctttcagctcttcaatgattcgtaagtgttcagcattgatcaaaccatcctcaactgtattttgcagaaaatgaccattgcacattcgggtaataatgattcctaagtattgttctttgcggatctgcattcgggcagatttctgagggttcaaccagccttgactattaagcgcatcgaaagtctttctttttgtttcgatttctttcggaaaaaccgactgattcaaatagtattctttcataaaaaacaataatatgaattcccttatttcattttcttcaccgatcaatcgaaattccttcgtcacctcaatgtcataatcattaaggatctgcttgaattgtttaaattctttatacacaggcgtatggcttaaaaaatggttcgtagcgaattcataaagtgaagacagttgttcaaaaaaacattctttcagcatggaaaatttcagtgactggtccaaataataggtcaagacgttatcagaggttgccaaaccagaagcatttaatttgatcacggtcccatcagtcacaataccaaactcttcatccaatccaaattcataaaagtccgtgtttaattcttgaacggtcttgttgatcaaaaattcggacattgtcagattatccatcaatgcctcttttgtctcggataaagaaaccgcattttccaagtattgaagcagcaccaattttcgcttatccgctttattcaaaaatgtcaaaaacatgcgttttcaggcctccatcattcttttgcccataaaggacacttccggtaaataaatagcacaagcttgtaagataagacggctgatcattgccatcaccacctgaatcatcgtctggcattgctaagtcgaccgacagactatttgcaaggaagatatcttccaccgtcacgcgttttgccagctgcttgccatcagccaaaaacggttttgttagattcagtaacggctgttccttttgactgttttcttttgatttgggttcttccttaggcgatgctggttctgctgcttttggtgtcttctcatcaacaggcgcctcgttgatttctggagggtctttcggaacgatttcttctgaaggattcagcggattatagatggtagcgaatacgacctgttcggtaacaaggtcgatcattccgataataatacaggctcctaaaacaaagccaaatttgcgtttcattgattatttcaccgccttaacatagttctatctggcatctcacttgggcctctcctcacgtaccatcaataatcgatgaatctatcaaagacagccccacaccattaggtgtagctgaaaaagccagctgttcttacttgctgctaacttgttgtcctaactggagatctttctccataagacttactttgagaaacaggaaagaaaatgattccgcaatgaatcggctatcgctcatcacttttcaaaactagttactctccttcattctttttctgacgatgccaaacaatcagaaatgcaatgatcaccaagaggagtccaatcaataaatattgccacgtatgatcttcttcgatagtgacatctttccgattgaggtctcgcgcaacatcgccagccactgtaaactcttttttaaattcccatctgtataaatatctttcttcctcatcaccattcttgactttatactgtccttcatcgctttttccgctgtaggcaacagatttcagcaggtaagtacctgcttcaagcttttgtccttctaatgagatgggataagaaaaatgggaatttggtgccatctgcataccagaagtatcagaagaatagcggctgtcgttttgcccttttttagtgacatcgttgatcaaacaaaatgaattcaaataggcagcggtcggattttgaaaagtcacattgattacattgcgggcattcacttgatcaggttcgacggctaacaacttcaaatctggaacgatttcatccgttgtttgtctcaacaaaattgcgacgacataggcatattcatttttgatcgctaatccttgatcctcggactgatcagaggcttcttcctgcttttcttttaatgtcagtccaccggaaatcacgcctttaaatgattctgaaggcatgcttacttttaaaggcaaagtcacttgagactgtttgggaatcgtgatggtctctgcgatgtctaccaaatccttcaaattgtgcgttaaggtttcatcaggttcgatatcattttgaccatactcaacaacgccgtttagattggtggttgccgaagcgatcttcggctcaatcactacgtccttatccgtatcatttcttaatagaacctccaccgtttgaacagcacctggtgacatcttcaaatcaaaataagtcttagatttgtctatttggttctctggtatgactggatttactgcaaaattgaattcagaggccatgcctcttaccgaaataaaaaagaaaagacttgccaaaaccagtataatgagctgtttactttttttcatgatggattttccctctctatctatgtaccacccttacgtatcaaaaccttacacttaaagggactggttgctatggatttgtcggggtatcagttagcagccaggtaaatgtggtactgtacttcacggcatatttcgttgttgaaccaggcacttctaattcaatactatctactgctgcgaataaactgtcaccccagctcataagataagtaccggctccttcccctttttgggcactcatgactaatgattcagccccattgggatccagggtaatcgtgcttttaaaattagaaggttttggggattcggatggtgtaacgatcgtcccgttagtcaagcgaatttgagctgcttttaattcttggtctttccctgttttaaattggccattttgtttgacatgcaacgtccagccgctttccgttcctcggttatctgtgacttgtacaaaatttggtccttcttgttctgcacctgctgcatcctcatatttttgcaatgaggcatggtagacttccgtttttgaagtgattttttgcatgccaaaatacaaactggaggcaaagtcgatcgataacggtccgttggttcctggttcaggtttgccatctggcgtggtgggatcgactggtttgattggattgtctggatctgggtctattggactgattggatccgttggctccgtgtttggttcaaagacaatttgaccatttgaatgataagctgccacttctgctgcttgagcagtgatcgtgctcgtcattcccaatcctacgaatactgctgcggttactatttttttcacttttctgccccttcttattcagtctctggtacatttttgaggtaccaaatcaaggttgttcgatattctttggctaatttaaccgaacgaccaggaatgtttaattttacagctgccgctccttctgatgcatcagcaccaaagcgatagatccaagtccccatccctttgcctgccgggacattcaccaagttcatttcactattgggaacaaatgtgtgattctctactactgttggtgcatactgcttatctgtcacagaaattgctgttccggaagaaattgataatgaagcccctgctagcacttcactctgtgctgtcttaaattgaccgttctgtatgacgctaagagaccagccttcttgagtcccccgtttatctgtgacttgcacataattcggacctgctaaacttgaagtgaactcttgcagttttgcatagtaatccattgtttctgatgtgatcttttgattgccaaattggaaactggaggcaaaatcaattgacaacggcccagccgttcctggatttggtcccattggatccgtgggatcgaccgggtcgactggtttttccggatcggtagggtcgactggtttagtgagatcattatccgtttcaaaaataattgccccatttgatgtatactctgctgcaactgcggtgatcggcaagattattgaactaaggatgacgatacccatcgttattaaactctttttcatttcatttgctcctttttgataaaatacctagtgctgccaacaagcaacccccatcgcgagttaactggaagagtcagaacccgttgtgggtaagattttatgtccttgttggtcgaatggctgatttctcagtactttcgcctatggtcttggattttttgctggatattcctaaacgccataaaatgacgttccgccattgctgtcatccgcgcctatttcagcagctaaggtagttgccaaaaacaagaataatcagccgagcaaacttgcattaatgactatttttatctttactcttctgccttttatggattgcctggagcagatactagttgccaggataacgttccgctatattcgcctattttttgcttttctaccggaacaactaatttaagacctttattcgctgtttctccccattcttgattcacatgatagtcgccgttttcggtcaattccgtctcttcaacgataatttccccatttgttagtaattgctcttccccattttttacaaagaacaacgtattttctaaatgatctgtcccattactcaagctctgctgttctttcacagtgagccgccaaggacttcgttcagatcctcgtgtatctttgacaatcaaatctccttgaatgtcaggccaatacgtttgagtggtggtagtgattttttgtgccccaaaatcgatagttgtcggtacactgctcaaggtcaactcaccagcgatcgccacattcactgttttttcagcagtttgcccattttcggtgaaatgatacgtagttgtgacattttttagcagctcttcttcgcttgtttgctggatcgattcgagtgcttctggtgcaacttgcggcaactgctcgtctcgaccatcagcaaaaatcgttgcggcttccgtatatgctgctaaatcagcttgattcgtgatagccgttgcttcccctaaagtcaagcggctatctttggcaaagacagcgaattgccgattgcttgccaaggcactctcatttttcacgactaccagattgactgcttgttctacagatgattgatttgctgctcctgctttgaatgaaacaagatgcttgcgagaagttgctgaccccaatggtttttgaatctctgctattgcttcttccgtcagactatctgtaaagaatgggcgtccttgtgcctgcaaatagtccagtgcatcttctttagtgaggttctcagcttcttgttctgtaatgattgcgttctgagcacgaagttcagcttgattcgagtaagaaaccttcacttgatagctgtattcaccatcgggaatctgccaatcgactggatctgaagacgattgttctgggattgtttctgtcgcactagcaactttgcttgactggatctgtccagcataaaaccaagaacctttattctgggtttctggtgtaaaggtcagtatcggtaaatttgacccagtatacggaataagcagccgccctttttgaacctggatgccagcaatatctgttccccatgcttgaatcacaagtggcgcattattttctttaacgcctgtcacgtcatgagtgattgaaccttgcccatcagcgataccgggcatttcgacttcatagtcgatcactgaaccaggaatcgcaattccgtagccattgactcccgtcacatcattgtccccaatgaatgttttaccagtcgctttttcgatgccgctaaaagtgatcggcgtgatcggcgtcgcattgtttgcaactggattgatagtcaatacttggtagcttgtgacttctccaaaccaagtgccctgactttttgctcgtgctgcagcatcattctccgtatttttgatccaagtcaaatgatctttttttgaatctggcacttcaaaatcggaaaggttgatccgaccagtacccggaggagattcaatggttgcctcatcttcgatggttaacttactgcctgaaatcatgttgtttgctgaagaaattccaataccggcatttttcgacagctggatcgtcccaaactggtgataagtcgtactatggttggccgctgtagctgagcgcccattttttatatccccaccggtagccatcaatgtcaatccgttagtcacagttaattcggtaaaattcacgagacctaatcctgtcatagatatgggctcatcttggtaagcattggttccatctacattctcgccaaaattcattttgacttgattggtgctgttagcaacgattgcattggtgaaattgtccgttgcatttccgccagagatcccattgatacttttcgccccttgaatacgcatctctacatcgcgcaaaatctgattagaggaaatattcgagtaataggtggtatataaattaccaatactggaatcttccgcttgaatgttcatcatgatcttgccgcttctcgtattgctagcagttcggccgccatccccataaatcgtggcaccgttcaagacatccgatcctggttttgtatagatgttcagcgtaatcgtattggatgtatctgttccgacaatatttgtactgttgaatggatttccgccagaaatattggtcccgctaggcagcttaaactcaccgtcataatttcttaaatccaatgttaaacttgcatttcccaatagtctgccattattagtcacaccgccagaaaaaccattagagccagttcgtggggtaccggaaaagttcccgccgaaaatccgattattcgaatttccgttgatcgtatgagaactggaatctccgtatgaagcccctagagaggcattgatcaccccatcataaaccgttactgccacgttcccaccaatcaagagatcgttccagccgccgccagacaagaaccaatccacttgtccgttattgactgtcgtttcaccattaccatagactcttctaccggtatagccagtaccttcaagggtgtctacgatccctgagttcaatgtattcgatgcatttccttcaataactccagagaaagagccgccataggtccagcgagcaaccgtattatttagaattgttttagtattccctttgatgtagatattccaggtagttcccggatctcccccaccgccgacaatatcccagccagatagttcccctcgatttttggttgttgtggaataagcaaggttggtcggttttgatcctttataagcaataccgtctccacctggactgccatctgctgtaatcgaccccacttcaatcgtggtattcccatcaatataaccgccgcgacctgcagctgtagtatatgttgcaccatttgaaaaagaaccgctgaccagatgggaggtaatattgccgtatactttgaaacttgctcccgcttctgctaattgagcccgttgtgcgggagtataattgtcgtaagtcgttgtattcgaagctcccatcgaactttgtgagagcgtgctgacattgttcccgccgccgccattgaaatcaccgatcccaccgacactagcgctaggacccgctttgaccgtatttacgatgtttccattgattgtgccagagtatcgattaccaccttcaaaagttgcccggcctgtagaatagagactcgaatcaagattcgttacgatggcatctttagcaggttccgagccaatatttccataataggaaccgccgataaaacgattggctgtcccagtccagcctccactaccggaaacagtgctgttgattctaccgtcgatcgttccatactgaacccctccgacaaacgttcccaaccgaaaattggcatttttcgtagcaatcgtcgtttcaacattcccagtcacattggctgcatttgtagcacttgatccaacaccaccgccataatagtttgtcaatgtgccattcaattgcttgatcgctacttttgtattgccatcgatcgttccaacattggctccccctgcaatggtacttatcccagagacggtattgtttacgttgatcgttacattccccttcaacgttccgccgctttggttgcccccataaatattccaagtacctgaacccgtgttattcacatggatcgtcggattgccttccagatccccactgtttgtgccaccatatatcgtaaagccatttccaacggcacccccattgaggaaaagactgtgcccgttcatgtaaatcgtcgatcccctatagtcgatattgcgaaacacgatatccgagccaaaataattattcgttgagaaatcaacccgtcgactgcctgaagccaatgttgtcgcatctgtgatgggatcgttagcatgaccagttaatatcaagcgactaactttcccttgtaatgcataaaacgtgatattgctactgtctactgtgcttggtattgttttggctgtcagatcagccggtaaagtcaaggtaccccctgatccgacatacaaagcaaactcaccgccattgccattttgatacatatcaaacaaggcttgccgaaagccatcgacactatttgcatactcagcgtaagtttccccatcgcctgcaggacttggaacggcaacaagtcgtgaaggatctgcacttgcaataatatctttgatggacaggtctactaaggaaccgctagaccggacactcacgccctgtttaaaaactgctagcaggatctgatcatgatctaggtccacgttttgcaatgcttcattactataaatttttccttctagctgccagccttcaaaggatgccggatttttaaaggaaggaatgtccgttgctgtaagacgttccccttttttcttgctgatttgaaggcttgtttctcctgtttccaacaaacgcccttcagcacttttgaaggttatcgtcagttcttctgactcttgtgaagaactagtaacagattcttgggaatgagattcagatgctgaatgtgctggcgattcatccgattctgctgtttcagtcgcttcagatgtttcgtttgtttcgttatcctgacttgcggtaccttcactgctttcactgctactttctctgttactcgtgatactttccttattatctatatcgctaagcttttctaactcgtttaaagtatccgttgtttcacttttttgcgcgatactttctgcatgtgcaactacctctgtatatgaaaaacaaggagaagatactaatagaaaaacaagaaaattggttaaaaaacgattcactttatccctcctgactgagtgaaaatgagtaaaatattgcgcaatacacgcattatgctatccatagtctatatccaaataaaaaaaggattataatttttttttcatccattccaaaattatgattataaattgacatcctaaccgcttgtttcttctcatttttggccttgtcaggcagtttgtttgacatttacttgaaatgcttggaaaggataaatttagagttaatttcacctagcatactaaaaaaacgtaagagttcaagagatataattagaataagattataaaaatcacataataaagcaatctttaccactgaaaaattaatctattatccgaattatttgtacttgatgcccctatatagaaatcgctaacatcatttatatttcatagaattaataatgttataacgaataataattcactgtattttctaaaataaaataactcaaagtataataactgaaaaaaattttataattttttctaaacaacattagaaaaataatacaatcataaaaaataaaataactattaatctaatttaacagcatgtatttttatttccgtgcgcaaaaaaagcaccaaacagtcctctgtttggtgcttcattttcaattatttggaaaagaacgtccatcaataaatgttgtatagatatgctcgtcctctacttgctctccttgaatcgatttgacgattttctctgaagcaatcattccccaacgatgcttcgagtaagaaattgtcgacaaccgcggctgtataaacgcccctaattctgtattgtcaaaaccaatgatgcggatatcttctccgatttttaagtctgttttacgtacatacttataaaccccgatggccatttcatcgtttaaggcaaagatatcgattggtcttagcggattttttgctaaaatttcttctgctccccgataccctgagggttcagtaaaatcaccagctattacatcataggaaatgccaaatcgggtaagctctttgatactggcttctaaccgttcttgactatcataacttttttcaggaccagcaagtaaaaagacatgttggctgccacctgaaatcaatttatcaatagccagtgccgcaccacctttattatccaaaaggacttgatggatattttcatgatcgaggatccgatctagtacaacgatttgatgtccccgctgagcataccgctcaatttcctctgaaggaaaagtccaatctaaaacgatggctccatcgatcatacgctctggtataaacaaatgggattttttgccgctgcaaacaatcatttcgtaaccaaaagtctcgagactttttttaatcccgtctagcaactctccatagaaactccccgcgtagtctgcgaggtacacgccaatgatgttcgtttgtctgcgcttcagtgtacgagcagccatgttcggaacataattcaagtcacgagcaatcgcttggatacgggcgcgcgtctcctccgtcactttagggctgccgttcaaagcataggatacagtggaaatagacacaccggcttttttagcaatatctttgatccctaccatggctcctcctttctatcgataaatatcgatatgatttatttccttattgaacaacggcagcactgctgatttgtctaaacaaaaggccccttttcgatagctgttttctgctagtgtatagtctaccggttggccattgatcaatacctgttcttttgacgcttcgtgaaaatggatcttaaccggttgatcaaagacccggtaggtcatcgttaagtcagataactcagttggcaagacaggatcaaggaacaaatcatctgccatttcgcgaatgcccaagacattgctgatcaattgattcaaatagatacctggtccgctggagtacacgcgccaaccgccttttacaccgacgcttccatctctaagtttaccaaaattctcttgggcttcaagccttgttttgaaatcgccgtcagagctgctgaaatagacattggcttgtcgcagttctgcatttggcacgcgttcttgcaactgaataggattgatgacccctaaagcatgccaagtttcttctttttgtcccaatttggccattgcttcagtaaaacggatgtgggcatgaacatattgcaacccgatttcccgaccaaagttcgctgcttgctctgcacgtttgaaattcgtactgaccccaccatgataagccgctggacgattcatcaagcgaacgccatctggatgttgcaagtgttctttgatgatgcctaaatggtgctcggcttcgtccggagaaagtaattcaccgatcatgctttgctgcatcggcaacaatcggtactgaatccctgtctttttgtcttctggatggatcatcaattccacatgttcagggtcttccatataaacaaatcctgggatggttcctgaggacaaaatgtatttatcaaaatctgtacgaatgccgctgacgatggtttgtaaatgatcagcataatttggatcatagtctttcagctgttccgctagtttcttcatcacttcataagttaatgcaactgtccaactgctggccatctgctttttcaatttgctattgtttggctgcagggtatcatcccagtccccatccccataacatgaaagatacgtaccttccaagaaattcgcttcgatatatgcaatctctttctgtaaatgatcataaagagaagcagtttgacttgtctttaagaacgtttcgcgatctgtataaggtatttgcgtttctaaaatcgcgaagtccttcgttttttccaagtaatcgctgacgactttcattggccacacaatcacatctccatgactttcgtcggctttttgtttttcgtagcggtcaaacataaaccattgcggccaattgccatcgtcggcaaattgattggcaaagaggtgtttgatgatcgacgcaacgatctctggacgattgactgctaagaaaaattctgttggtccttgtgagacatctctggtcccccaagcagcaccgccatactgttccaaaccatgaggagacaaataatggaccagcatgttgtgcgtgtaccaccgagagagcaaattaagagtttggacttctgcttggtcatgggtcaattcaaattgattcagcagtgaatcaatgaacgtcacatattttgcttcttcttgctgcttagaagacgcttgttctcggtaaggatctccggtcaacgttccctgaatcttaagggtaacttctgactgatccgcaaatgtcagaacagttagtgcgccatcactgttttcttgtaagaacaaggaatcatctgtcacatcaaaaggctgatccgcctgcagataataagttaattctggatacgcttcttttactggtgacgtagtcccgcttgtgatcactacttgctgctcttttttcacaaccgctgtcggtgcttcttcatctggccccatcaaaaactggttgctgatggcccatgaataagcctttttgctatggatcatcgttcggatctcacggctgtcaagcagtgtatacgtcgtgaccgtgatcaaatcatctgctgttttgtaataccacgttgcagagttcagccccatctcgaacgcagatggcatcgtcaataagcgccacgtatcctgttctttcaagtagatccgctgtcctgatcgtttcatgacattcaacgcattacggctgttactcaataatttattcattgacgtattccctagaacgatctgcgaattgaaaataccatacatataaaccgtcgtactaagcaacggctgatctaccactagatcactgccactcagcaatatatgcccatgagcccgttccatggcactttctttttccttcaacacaacgtgacggtagttttcggtaaaaaatgaatacatttggccatcgattcgttccattgcttcctgttttggaaatagcgcggaaatatctgcttctgacaaggtatctccagtcaatgctgctccgagttgttttgccggaagtagctgtgtcgtcaatgactcaaaagtcaatttttgaaactgttccttcagagaagggcggtcgaattgcggaccggatactgcttgtggctgatctgccttgacagcactataaaaaatgacttctgttgtttcgtcagatagctgataagactcggactgcaaagcaatgtaggcaaattcatattgatacaattcattcgctaatgtttcgtgcgctaaggcttgcggcaaattagtcaccttgtatgttctgccaaaaaattgatacccatctgttgaataactccgcaagggttggaaacttccttgttcgactaatggaaatttgccggattgcggttgattttgacgagaagagacgacgatcgttccgttatcctgagtcacgtggtgatccagatattgagaaacatacgcttcattggactgaactgctccttttagtgcattgcctatatcttgaccataaatgatatctgcttttccagaacccgttaactggattcgccaaaaccagcaatcttctgccagttgcaagtccacttgataatgaacgtccaaaaactctcctgaccaagacaactgctgttgggaatacccaaacttactggctgaattagaaccgaccatcggtgtccaacgaatcccttctgatgtatagactcgcagatacaattgattcaaactgccgtctaacggattgccatttagttgattgatcatcatgccattgctatctatttcatacagatccccggttttcaaaaacctcaggcgtgtctgattcttttcaagagtaatatattgtgtcatataaaccttcctatccttatcttacgaatttgaatgtagccatctgcagatcgcgactgttgctgccgaccatggcttggaatgtgccagcatcactggatgtttcctgattgctgtggacgtaacgcaacatatcttccgtaattgaaaaagttacttctttggtttcccctggttctaaccatactttttggaatccttttaattctttgattggtcggacaacttcaccaacgaggtctcgcagatataactggacggtttcttcaccagcaaagtcgctattattcttgatctgaagggatactgtcagtgtctcttcagcagacagttgtgatttatctaaacttaactcactatactgagcctcgtgatagctcaaaccgaaaccaaaaggatattttgcatagttggagacatccaaatatttcgagacatatttttcatcaggtgcactttcataaggacgaccggtagtttcagtattgtaataaacaggtacttgaccgactgtttctgggaaagacatactcaaacggccgcttggattgtattgtccccataaaagatttgctaatgcgtgaccaccttctgttccagggaaccatgcttcaacgatggcttttgcttcatcaatgccttgaagatctaatggacgaccattatacaaggtcacaacgagttgctcattgactgcctgcaattgtttgaataatgctaactgcgcttcaggcaagcgaatatcgctgcggctcgctgcttctccgctcatccagtcttgttcacctagtgcgagaaccactttatctgcttgtttagctaatgtaacagcttcattgatcgctgcttctgttggcgcaaaataatcgaatggttcttttccataaagaatgttctctgaaactgctttgctcccttcgatcaatgaaacggcttcttcttgtttcccttgccatgaccatgcacctaaaatatctttagagtgagccgctggtccaatgatcgcgaccgtctccgttgatttaaatggtaagatgttctcattcttcaataaaaccattgatttttgagcgatttctctcgcggctgttcgatgttcttgcgaaagtacgaccctagcttcagcagcttcatctgccccacgatgaggattttcaaaaagaccaagatcatttttaagggtcaagatccgcaatactgcttcatccaataactcttccgcaacagcgccttcttcgatcaattctttcaaataatcgttgtagcaagtcgtcatcatttcaatatcgacgcctgctttgatcgctaattctgccgcctgtttctcatcctctgctgcgccatgggcaatgatttctttgaccgcaccccagtcagagatcactacgccatcaaaaccaaattcttttcgcaacacatcacggaacaaccagcgattcgctgtagccggaatcccatctaccgtattaaaggaagtcatcaccaattttgccccagctgctagtgcggcttggtagcctggtaagtaactttcccgcaattgacgctcagacatattgactgtgttgtaatcacgaccgccaattgctgcgccatacgccgcaaaatgcttcacacaagcggcgacccgttcaaaatcattggtcaagtcttctccttggtagcctttcacgaaagcctccgcaaggcgactgttcaagtagggatcttctccggtagattccatcactcgtccccaacgagggtctcggactaagtccaccattggcgagaacgtcacatggagcccagacacagcggcttctctagctgaaatttcggccatttgttccgcagcattcagatcccacgaactacctagagccaatggaatcgggaagattgttcgaaacccatggataatatctgccattagaatcgtcgggatctgcaggcgattgtttttgatgtattcttgttgtactcggatcgcttctttggcaccggaaacgcctagcgttgttccagcgttgttgatggtttcttgggtcagtcccagatcactcatcggtccggttttttcttccgctttgtctgaataaaacgcagcagccagttgcaataattgatcgattttttcatcgatagtcatttgttcaagtaagtgcgtcaattttgtcttttccatttttgttccacctttatcgttcatcgaatcggagatctgcttccaacgggaaatgatcggaaggaaaccgtccgtcacaagaatccgtcaaacacccggttttaatgattcgaaatcctttagtataaatataatcaatttcttctaactggttccatgggagttgatagtcaaaattttgataggaacctctgggaccgtaatgtcctttttcattttgttcttttgcgttaacaaaaatcgtttgcagggattcatggacgcgttcaactgcttctgcattgagatcccccattagtaaaacgggtaaagcggcgattttatccgctaaccgttccaagatgactttcatcccttcaaaacgggcgatttctgaaatattgtccagatgcgtgtcgatgactaaaaagtcatgtccttttctatctcttagtaccgtccacaaacacagacgcaagtattccgcttctggatgaatacttggcacatcaggtgtcagagataaccaaaatgagcctgaatctactttagaaaacatcgtcttcttgtaatagatcccgataccttctcctgttccatcgccgtctcgttcagcagttaccgactcgtaatcagtcaatcttgctaaatcagcgacttgcgtcggccggacttcttgtacgcacaaaatatcccaatcatgataatcgatcaatgccaatactttgtccgcacgataagaccattgccactctttatcgtaatccgtatccacacgtaaattgtaagttgccactttcatttcttcatatcctttttaacaatttttggatctgttgcatttcttttcgaatctgtttggcttcaccgccgccatgccctttgtttaaatacacagttaattgttttggggttgagattcgatgataactgacaaaaaaatcggtcattgggcagataggatcctggctccctactgaagcaaagacagggccagtgatttttgctgccagatttttcaaatcatagtaggccatttggtaatagatggtctccttgctatctggaaaggtatcgatatattcttgcatcacatgatagctcccagttctgctttcgatgcggtgagaaatattcgagtgactaggaacatctgcaaaagtcgcaaagattggcgtttcagccagcgcattgacaattaatgcaatcccgccgccttgtgacccgcctcttaaaatcactcgttcagaatcaatctccggcagctctgctgcgacctctagcaggcgaagactatctgcaatcatgcgtttcatataaaaatcttctttttttaaaattcctcgaccaaacggtgcctcatgttgcgtcgtttcataaggatgtgtatctttcgtacggccgccttgcccgcgattatcgatcaccaagcaggcacaatcaatcaatgcccagtgggcaaactgaaagggttcctgtaggtgattcatataacctaaataatcgatgacgattggaagttggctcttatttttcggaactaaaagatagccgtaaatcgtttcattgtataaactttggaaattgacctgatagacatcgattcctgtcagcaatgctggttgttgctttcgttcaaacgctaatggaatctgtttgatttcttgtttgacttgtcgccaaaaacggtcgatttcctcctgagatggttcatttctaattgatttcattgacgtcaccctcttttgcccacaccttatgaaagaacagtacttgcagataagcgaatcctgaaatacctaaacatacgaataagaaagaattgatcttattcagcaatagaaatacgaatactggaatcactagcaagataatcgcatttgcggtactgctcaacaccgcataggcagtttcgtgtgcggtttgtttgactgtggaagaaaacaaacaaaacagtaggacaaacaccgtcaagaataaaccagctaaactgctgagtatcactgccaacaccccaagataagtggtgattcccatcaatccataaatgatcgccgcggtgacagcaacataccccacgatgatcccttcaagtacgattccacgtttgatatttgctagaaaagctcgactataccgttgccaaactggaacatctttttcttggtaaagctgatcgatggtttgatacaaggcgatcaaggctggtcctgtcagtacaatcgtgaccgcaggaacaaggaacaaaaaacttaataggatcatatccgcggcaaaggaaaagacacgatagtaccatccttcataagagaaaatttgtttcatctccactcacctgctccctttctagtttcaatcctactgatttcttgttgttttcttactcatctcttgtttattatccttttgctaaagtagtaaaaagatccttttacatatacttttgttggtacttttctacatctgctcgtctacactgcgcttcgcctacagttgcttctaggctggcgccaagaagaacttgcatgccttgctttgcaagccaatcgcagtgtttcaaagcaaaaagaggaaaggtcgttgggtctcgctttcctcttttcatcctttctataactgattatttaagtttttcgcggttttctgccattttttcagatttgacttctttgattgcatcccaattgttggaatctaaaaaactttcaaaatcagacagtgttgaatcaaacgttttttcatcttttgaacgaatcaaggagatgactgtgctatttagttttgttttgatcgaattattggaacgagcttctgcagtcccagcatctggatctgtgttctcaataacaaagtgcggataaagttttccttcaccccattcttgcatttgggttaatgcgctctctgtttctactttcaatgcattgacacggtcattgttgaagtagttgaagcgactgataccatatttcttgttgtacccttcgttatctgttttctccatttcttttacttcaggtaagtaatcgattttgccttcgtcattgtattcataagtgacgccttcaacaccgaatttcgtcaagatttgtcctggttcatcgatcaagtaagtgaatagttgagtgacttttgctggatcgactgcatcttttgtgatgtagttgatcaaccagcctgagataccggtttgattcaatgttggtttccggcctgatgtgctggctggtccatcaatagcaatatagcgagtatcagaattcttcataaattcagtaaagttgccgccttgaccactagttcctgcaacaagcatcgttgcatatttcccttgttttactttttcatcataggtcggaccgtcatctgtaaagctgtcatcactgatgttgccttcacggtatactttgttgaatgttttcaaccaattgatatattcttcatctaagttgcggtcatagtaattaccagattcatcttctaatggaacacctaagaagtcttgtaatttatctaagaaaggacctgctgtgtcaccgacagtcgtgaagcccattggggttagatcaggatatttctctttgatttgatccattactttgacaaaattttctggtttagaaatgtctggtttgccaagtgcttcatagacatcttcacgaatgacgaagttatcatttaccggaatattgccgctttcataatcggctgctgtattcgaatagtttggatagccatatgttttgccatcgtctaatgcaaaccaattgaaggtatcttctgttacgacattcaataggtaaggatcatattttttcgctagatcattcaatgagtaagcccagctatctgctttagtggctgcttgactggttttgtccatcaatgtcacgatgtctggcatatcgccacttgaaataagtgcattcaacttcgagtcgtctccggaaataaattcgatatcgatatttaaatctttcttgatctgtgcggtggtaacatcttccccaaaaggtaatgccgtccagtctgagttgatgtaccaagtgattttagttggttcttttttggtatcaagtttccatgctggtgttttctcatcaagctcataacgatctttgatcgaaaaatctgagctgctagcgtcatccgagctgccgccacatgctgctaagctaagtaatgctgttgctgccaataaactgcctaatacttttttcatactgatccctctttctattcttttaccgcaccggccatcataccgccgatgaagtgtttttgaagtaatggatagataatcaaaattggtacagtcgtaataacgatagtagccaattgcaccccgcgggtcgttgcctgcacgacaaagtcggtactaccgctttcggtcatcgtgcttaagttggactgcacaatgatttcatagatcttcatttgcagcggatagagatattctttggtgatgtacaattttgtggtcataaagtcgttccattgtccgacaccattgaacaatatgatggtagctaatgctggtttcgttaatggtaggaaaatcttgtaaaaaatttgaaattcgctggccccatcgattttcgccgattcttccaaagaaggaggaatctcacggaaaaagttcatcaagataacgacgtcataatagctgaataacgctggaatgatatagacccaaaatgaatctagtaaccctaacgatttgatcagcaaataggttgggatcatccccccgccgaagtacatcgtaatgactcctagcgtggtgtagatattccggccgatcagccgtgatttactgagtccgtatgccacaacggcacaaaacagtgtatgtgtcactgccccgatcaatgttttcagtacagagatcaaaaatgcccgtgggatactgtcatcggaaaatactttccggtaattctcccaagtaaatccccgcggccataaaacgagaccgttttcagccaaccctgaactagaagataccgatgagactaagatattccagattggaataatgatcagcagcgaaaacagaacgaggatcactgtgttaaagaaataaaaccatttgttctcttgtgttcttctttttatcacttggtcacccctcctataagataactgaattgccattgttcaatttgcgtgtcacacgatcggtgatgactagaagaatgacagaaatgattgctattcccaagccaaccgctgttgcatatgagaaatcgccttgtgtcagacccattttataaacgaatgagttgatgacttccgatttgttttggttttgtgaattcatcaaaaccaatgtctggtctaaattagatcctaagatgccgctcacatttaggatcagattcaatgaaatgatcggcgtcaaaagtggtaatgtgattgtccgaatctgcgtcaacttggtggcgccatcgattctggccgcttcataaaaagttggatcgatacgagacattcctgcaagatataaaatcgttccccatcctacttctttccaaaggtcagataaaacagcgatccaccaatatttattaggatccaacaaatgattgacacctttatccatcattcctaaagacatcaggacttggttgataaacccattggtcgacaaccatgaaatcatcataccgcctaggacaatccaagaaaaaaagtgagggatatacgaaacggtttgaataaatttcttcaattttccgtcccgcatctcaaaaatcataatggcgagaataattggaatcgcaaagcctaagcctaacttcatcatactgattgctaacgtattcccaactgcttcccagaaaaaactgtcgtgtaaaataattcggaaattctctaaccctacccatggtgcagaggaaatcgtatcaatgaccgtataattcttaaaagcaataatgattccataaattggaatataattaaatacgatcatgaatgccacgcctggtagtaccatccaatgcagttgccgctgccggtatatctctttcagcttactcatacgcaaaaaccctttctgttatcgtctcaacgctcatcctatctttttctttttagtgaaacgtttctacgagttgattataaatcgcgctagaaagaaatgcaagcctttacatcattaaagttttatcatttttcattatctcatttttaatgacttacatatcctttaaagatatttttcacaaacaaaaacctttaataacaaggttatccgctacaccagatcacttatttttgtttttctacagctcttgcaactgtttattgcgttgtttcttttctcgaagcaactaattttagaacatgaacgatagaaaaacgtttcactaaaccataaaaaaaagagctttacagctcttcaaaatgattttcatagccaaaatgggtataagcaagtgtggtagcgatccgtccacgtggtgttcgtttcaaaaaccctctctgaatcaagtaaggctcatacatatcttccacggtctctgtttcttcaccgatgtttacagataatgtgctgaggcccacaggccctccaccatacaactcgatcatcgttcgaatcagcttctgatccacataatctaaaccagcatgatcgacttgcaaaagcagcaaagctttatctgcgatttggcggtcaatgattccattcgcttgcacttgcgcgaagtctcgaacacgtttcagcaagcggttagcgatccgtggcgttcctcgagatcgtcgagcaatctcaaatgccccttcttccacgatctccgtctgaaaaatatccgctgaacgtaagacgatttcttttaagtcttggtcttcataatattccatatgagaaatgatcccaaatcgatcccgtaatggtgcagaaagcatccctgccctagtcgtagctcctactagggtgaatggcggcaacgggaaatggaccggatgcgcagttgttccttggccaaccatgatgtccacgaagaaatcttccattgcagaatagagcatttcttcggcaactcgcggcaaacgatggatctcatcaataaacaagacatcccccggctgcaattcattcaaaatcgcaatcaagtctcccggcttttcgatagcaggtccactagtcgtcttgatgttgaccgccatttcattggcgatgaccatcgccattgtcgtctttcctaatccaggtggtccgtaaagcagcacatgatccaatgcttcttcccgatttttggctgcttgaatgtagatcgacaactcttcttttactttattttgaccgatatattgcgcgagaaactgcggacgcaatgatttttcgatcaattcttctgtttcattcgtttccggtgaaacaatccgttcatccgtcacctaactcgctccttattttttcatcatcaattttaatgcttctcgtaagtattcatctgttgatttagtcgtattaggcgctaaatatttctcagctttcttgatttctttttcactatagcctaatgctttcaaagctgccatcgcttcgtccaacgcggtattcgccacagtgactggtgccgttggctcttcaccgactaattctgcgacttttccttttaagtccaatatcatttgctgtgctgtttttttgccaacacctgggaatttggttaaataagtgacatctccgttttcgacagccgtgatcaatcccgcatggtcttcattcgccataattgccaatgcacttttaggaccgatcccagagacgctgatcagttttaaaaataattgctttccttctaatgtagaaaacccgtataaactatgggcatcttctctaattacttgatgcagataaatcttcacttcttgattcagcttgccgctgaacgcatacggattgccgaatgccacttgataaccgataccgtgcgtttcaacaacgatatacgccggaaagatatccgtgacttttccaataatatattcgtacataaccgttcctttctatacatctagctgtacatacgttccctttattgtagcatagactgaaagacaaaaaaagaagcaagcgaagcttgctcctttactcaacaagagaagtatattctccatatccttgctcagccatttcttccaatgggacgaatcgcaaggctgcggaattgatgcagtagcgcaacccgcctttgtcttgcgggccgtctgaaaaaacatgtcctaaatgggaatctgcttctttactgcggacttcgacacggtgcatgccatgagagaaatctgctttctctttgatttctttgcggtcgatgggcttcgaaaaagaaggccatccacaaccagcatcatacttatctgtcgaagcgaatagcggttcgccgctgacgatatccacatagatccctttttcataaaaatcatcataagtccctgtaaaaggacgttcggtcgcattttcttgtgtgaccgcatattcgatcggtgacaatttcgctatcaaatcttcttttgattctgacatttttctcacctactttcttctcttatcttgccttttttccaatcgtttgtaaacgaacttgcttctttacttaagaagagggcagttctggccacattctggttctttcagcaaaatgataaaacggcggctggtctttcgtatagatttcttctgtgaaaactgcttctgtcaattcttgaaacaaaccagtggcaaagaagaattctgccgtctcctgtgcataataaaataagctagagccacactggcggcaaaatcatctttgcgcccaattagaagagttataccgttgaatcaaggattcgccagtaaatgtgatttgatcacgggaacaagcggccagcgctaaaaaaggaccaccatgaaatttctgacacattgagcaatgacaagcagtcacttggggatgaacctccgttagctcaatcgtaacttgaccacaaagacacctgccggatagattcatttttccagctcctccggaaattcttttaataacttggcaaccgtattaacagggaagccaacgatcgtataaaaatccccttggatcgcttcaacaaacacttttgctgctccttggatcccatagcccccggctttgtcttgatattccccagttttcagatactcggtaatcatttgctccgtcaacagactaaaggatacttgtgcagaaaccaatttttctcgtcgtttttcttgtttttgtaaaacgaccgcagtatggacccaatgagtctttccactcatcttctgcaacatccgtctggcatctgcttcatcagcaggtttgccgaaaatctcctggcccaccactacggtagtgtcactggcgatcacaagatctgtgggaaagcaggctgtgacagttgctgccttttcccgcgccattcgctgcacatactcctctggtgcctctccaaataccacagactcatcgatatctgccggctgtatctgaaaagatgggaccaattccgctaataattcttttcgccgtggcgattgagaagctaagacaatcattccattccactccttgcacgatgcggatcttggatccgtttaaacattcgctccatatcactattggtaaaatgaatcaataccggacgtccatgaggacaattgaagggattctcacactttgcaagatccgccaacaggattcgtgcttgcgcctcatttagataatgattggctttgatcgaacgtttgcagctcatcatgatcgctgttgcttccctgaatttcttgacgctgactgaacctgtctctaaaagcatgtcgatcatttctcgaatgatgctttcttcttctcctgctgggtaccaagtgggatgcgcccttacaataaagctgttcgccccaaactcctccaaatggatcccaacttcttgtaattttttagtttgttccttcaacttgatcgcatcattattgggataatctaagacgatcggtaccaataattcttgcagatcgtcgctcacttctccgattttttcccgaaaatattcatatttgatccgttcttgggccgcatgctggtccacgatataaagtccttcgtcgctttgagcaaacaggtacgtcccatgcatctgtccgaaatattctaaatgagggaaacgttgcttggcaggcgtttcttctaacaaacgatccacatatttcgtatagtttttctgtccggcatgcagttcaggatgcagccgttcttgcgcctgctcttcgattaacgacaagtcctgctgactagcatcctcgagaacagacgctgctggttgatcaacttcttggacaatctctgtcacaggtcctgtcgcagcaaagggatctcgcaacgttttattgggcagtgtttcttccagactatcgaaaactgcttgattttccacagaatatgccgaagactccggagccttttccctttgctccgcgctttctggaagttttccaccttcctccacagggttttccacaaagttacccacagtctgttgataacctgatgacgccacttgaaactttcctgtctcgcggttgaaagttaatcccgaagaagtcgtaggactcgttcccagatccagtttcgtttgttccacaggttcagtggtcacttttttcttaaaacgaagattatcggcagcattcggaatcaaattctcttctcgcaaactgtcattgatcgatttactgatcaatttggtcagttcttcttcttttgataaacgtacttcttgtttagtggggtgaacattgacatcgactaataatgggtccatcgtgatctccaggaccgcaatcgggaatcgtcccaccatcaattttgagccatatccagcgacgattgctttattcaaggcaaaattccgaatgtatcgtccattgatgatcgtggatagataattacggctagcccgggtcacttcaggcaacgagacataaccagtcagcttaaaatcaagatcttcactattgatagctaacatttttttagcagtctcaacaccatagatcccggcgatggtttgtttcaaatccccgctaccagtagtagtcagcattttattgccttcatggaccaagcgaaaagcaacttccgggtgactcaatgcaatacggttcacgatatcgccgatattggccaattctgtctgcaatgttttgacatatttcaagcgcgctggcgtattataaaaaaggttttctacagtgatcttcgttccttgccgcaagttcgctggtatatgttcttccacagtgcctcccttcaaccgaaggaatgagccttgagaagcatctttgacagctgtttcgattgttaaaatcgagactgaggcaatacttggcaatgcctcaccgcgaaagccaagtgtccgtatccgaaacaagtcatcgcggttatggatcttgctggtggcatggcgcttgaaggccgtaacgacatcttcttcggcaatcccctcgccattatcgatcacctggattttgcgtagaccggcttcttcaatgaagatatcgatctgtgtgctgccggcatccactgcattttccacaagttctttgacaacagaggctggccgttccacgacttcaccggcagcgatttgattcgctagacgttcagataattcttggatcttgcccatctgttttccttctttctagattcgtttttgcaattcataaagcttatttaacgcatccattggggtcatttctaagagattcagttttttcaactgatcgatgacgccaacttcttctgtggacacctcgctaaacaatgaaagctgttgtgtttcttctatcacaggcttttcgatcgttggttcatgttcttccagagctttcaagatcgttgccgcccgttgtagtaatccgctaggcagtcctgcaatttttgccacatggattccgtagctcttgtctgccggaccttccatcattttatgcaggaagacaacttcaccgtctttttctaccgctcctacatgaatgttccgcaaacgcagtaattcttcgtccaatatggtcagttcgtgataatgggtcgaaaaaagggtcttcgctttgacttctttatggatatattcaatgatggcttgagcaagtgccatcccatcataggtggctgttccacgccctaattcatcgaataggatcaaactgtttggtgtggcatgacgcaacgcctgattggcttccatcatctcgaccatgaatgtactttgtccagcaatcaagtcatcgctggcaccgattcgggtaaagatgcggtcaaaaatcggcatttctgctgattgcgcaggaacaaaacaaccgatttgagccataatcactaacagtgccaattgccgcatatacgtactcttaccagacatattcggtccggtgatcagtaaaatatcggtgtcttcatgcatcacgatgctattaggaatatattcttggtgccccagcactttttccacaacgggatgacgcccatcgacgatattcaaggatcgctcttttttcaaaactggccgtacatattgatagcgttcagcaattgtcgcaaaactttgtaacacatcgactgcactaatggctttggctaatttctgcaagcgaaggatactttttttcacttcttctcgtacttccaagaacaattggtattccagatccaccgatttttcttccgcttctaaaatcactgtttccagcttctttaattcaggtgaaataaaacgctccgcattagcaagggtctgttttcgttcataacggccttcttcgagaccagccagattggctttggtgatttcgatgtaataaccaaaaacacggttgaagcccacttttaaattcttgatgcctgtttcttggcgttctttggcttctaactcagctagccactgcttgccgttgcgcatcgcttcccgatacttgtctagttgttcgtgaaagccatctttgatgacatttccttcagtgatctgcagcggtgcgtcttcatcgatggcgctatcgatcaatgccactaactcatccagtggctccaattcgatcaacaggtcattccactctccacgattgatgcctttgatcaactgggcgatcagaggaacttgctgcaaagaagatttcagctgcagaagatcccgtccattgacattgccaaagacaactcgcccaactaagcgctccatgtcatatacttttgtcagtgcgtcttgtaagtctgctcgttcaaaaaagctgtccaacaatgattgaaccatttcttgacgtgcaaagatcttctttggttggatcaaaggacgatccaaccactgcttcaataaacgggcacccattgctgttttggtttcatctaataaccataagagtgttccatgcttttggccagttcgaatggatcgactcaattcgagattgaactttgagtaatagtccattttcaaagaatgatctggttgatattctactgcttgctggatatgagccaagctgcgtttttgggtgattgcgagataactcaataatttgccagtgaccgtcttttcatcttcaggcaatccgctagtcaaaaaacggaattcagcattttcttcatatgtctcttgttttgaaaaaacaacactcaagcgagtggtcaacagttctttaagggagtcaggaacttcgctgcacaaaacgacttccttggtttgtaaggcagcggcctcattcaataccgcatcctcgtcttctaaaagcgcggtctttaactcaccggtactcaagtctgcataagcaaaactgtaaccttgcgtcgttttcatcacagccgtcaagaagttattatctttggcggacagccctttgctatccatcactgtccctggagtgatcaattgaacgacttcccgtttgaccattcctttggtggttttgggatcttcgacttgttcacagatggcgactttatagccttgttcgatcaacgtatcaatgtaattactggcggcatgataagggactccgcacattgggatcggttcttccgcatttttgttgcggcttgtcaatgtcagctccaagatttgtgcagctttgatcgcatcttcattgaacagttcatagaaatctcccagacgatagaacaaaaaagcatcttggtattgtgccttgatgcttaaatattgttccatcataggagtgtttttagttttttgaggcatgagcatcttcctcctcgatggctttattcacttgcttttggatttctgttgtgacgtagtgcagcaattcatctgcttcctgaagtgccgcacgataggcgatcacgagtggatgctggtcatattgttgggtcaactcagccactcgtcgcaaagcatccttttttgcttccggtttatcataatgttcatactgaacgatttctttttgggtttgcttgattgcttcttctaactccagcagtttttgattcttttgcgcccgttgttgaatcctttgaaactcttgtactaccgggtgttgtgccaataattgccgcaacgcagccaattcttgtgctactgctgtttctttttctaatgggtccatgattctcctattctgtaaaaggccggtcttcgctgatttggattggacgaatcgatttggcttttccagtttgttcatcgatctcgatcagacaagcggacaaaatactgcgtccgttctcgatcacttcaaatcgttgcggcaatgccgtcaagaatttttcgatgataggttctcgtttcatccctaaaatcccatcataaggaccagtcattcctacatctgacaaataagccgttccttgtggcaaaattcgggcatcattggtttgtacgtgggtgtgtgtgccgacgactgcagaaactcgtccgtctagataccagcccatggcttgtttctcactcgttgtctcaccatgaaaatcaacaaagataaatggtgtacgcttgcgggcgatagtcaccaactcatccattttacgaaaagggtcatcaatgtcgaccatgaaagagcgtgcttgcatattgatgactgctaattcgatcgcattgactttcacaaagaccattcctgtaccaggagtcccttctggaaaatttgccggacgaatcattttttttgcatcaccaataaattcaaaaatatctcgattatcccatgtatgatttcctagtgtgatcacatcgacgccatcttgaagaaatttcttataaattttccccgtgatcccccgacccgcagctgcattctcgccatttgcgatcgtcacttgcggccgataggctttcttcaattttggtaaatactctgtcaaggtatttctccctaacgatccaaccacatctccaataaataatacccgcacactttttcctcttctcttttaacatctttctttattataagtgtttttcttgagaaaaaaaagagctattccataacagcaaacaaccttaaactacaggaattccttcctaccgactgctcttgttgctcttctaggaccctttagaaaataaaacactctccaaataacgttggtcgtttggagagtcatcattattcagcaacacgtttcacgatcgcaacgattaagtcccgcgcctttgccatcgcttcaacagtgataaattcatattgaccgtggaaattctcgccgccggtaaatagattaggggttgggatccctttgtaagtgattttggacccatctgtgccgccgcgaaaaggggcttcgatcggtgtgatccctaagtctttcattgcttgacgagcaatgataacactttgaggattttctttgattcggtcgcccatattgtagtattgatcatacagctgataggtgatccgctcaccatagtactcattcaacttttcaatgatctgcaccatcttctccttgcgcttttggaaaagcgtttgatcgtgatcacgaatgatgtaggagagttctgcttgcccgatatgtccagaaagattgtgaagtaagtaaaagccttgatagtcttttgttttttccgggacttctgcttgcggcagtgccgcatcgatctggttggcgatctttaatgcattgacgagacgaccataagccgtcccaggatggacgcttgttccgttgatttggatatcgatccgcgcagcattaaaggtttcatactccatatgtcccacacgaccactgtccattgtataagcaaaagccactgggaaatcggctgggtcaaacagatccgcccctttcccaatttcttcatccggaccaaaagcgatccagacatctccccgttcttgtggatcaatcgtttgtaaaatccgcaatgcatcgatgatctcagcaatcccggctttatcgtctgcacctaggagcgtcgttccatctgtagtgatcaacgtctcacctatgtagtctttgaggttaggaaactcagcgactgtcatcatgatccccaacggctcattgaggcaaacgtctttgccatcataattttcatggatctggggttggatgttttcggctgcaaaatcagcggtgtctacatgtgcgataaatccgacagccgttttgtccggatttcctgcaagacgtccgatcacaaagctattcttttcatggtacaacacatcgttaagccccatagactgcaattgatcccgtaataaaagtgccagctcaacttgtccaggggtagtaggaattgtttggctgcttgcatcggaacgggtattgattttggcataacgcaaaaaatcggcgatcattggtttgtccttcactttcgtcacttccttcaaaaagataatggtcgatggtccgtttcatggatgatctgtcggaaatctgcaaatcctgcatctaatcctcggagcagcatttctgctgtaccgatattcgtagccaacgggatttcataaacatctgacagacggatcaatgcggtcacatccggctcatgtggttgcgctgccaatggatcgcgcaaaaaaatcaccatatccaacgcatcctccgaaatcatcgccccaatttgttgatcgcctcctaaaggaccagacttatagcgatgaacggatagtcccgtagcttcttggattcgttttcctgttgttcctgtggcatataattgatgctgtgccaagatttcgcgataagcggtgaccatcttcaccatcaattcttttttgcggtcatgggctatcaatgctattttcatcttcactcctcctcttttttccattgtaccaatacttgctgaaaaaaagaaactgtgctcccaagaataagacattgcctaatcttacacagagcttccatcatagaatcaaccggatcccttagtaaaataggtaggctgccaccttaagaaggggcaccgaaggaaatccttctggcaatttgcggggctgatttctctgatttggctgttgcaaaaaatttcaggtttgtctgtttcttaggacacagtttgtttaaatcaagtctagttctttcaatgcttgccagatgccatcctcatcattgctggcggtgactttatcagcaatcgcttgaatctcgggagccgcgttacccatggccacgccgacgccggcagcttgcagcatttcgcgatcattttggccatcgccaaaacaaatcacatctttttgtgagattcctagttggtgtgccaccgaaagaatcgtggctgcttttgaaccatcttttggcacgacatcgacactgttttcatgccagcgaacaaaacgtaatttactgtagcgatcgtcaaaatagtcttcatactctttcccataaaaagccaacgcttgatagacttctttttcttccggaaagtgcatgtctaattcaggcaattgtgcgccaaaagagcgcattgcttcatccatgatgccaatatttaaagaagaagctcgtttagccgtatccattcccacaaatgcggtatcgatccctaactcgtttgcttcagcaacaaatgcttttagctgttcttcatctaataaatttttgtacacttgttggtgtgccaaaaatgcagcagcgccattgcataaaatataattatcaaaagcaagggagcggatgatgtctttcgcatggaaacgactgcggcctgtagcaactgtcacgaaatgcccagcatttcgcagcaactccaatgcttcaatcgtactttccaacggttgcttgttcgaatccagtaacgtgccatcaatatcaaaagcaaagaatttccgattcatatccataaaaaactaagactctctttctgtaagaaataacaagaatttttacttttggatcatgttctctccaaaaagcataccctattcttaacataaaaagctgtctatttcaataagtggcggatcttggtgaatgactcttgcttaccaatgaaggtggctcattttttggggaaactgaaatattttcaaccacatgaagtgtttgcctcaatcgtctttgtctatttggcagtgactggttgagtgccccagacttcatctgccacttcaatgatcagctgcaatttcttccattgatcttcttctgacagaatgttgccctcctctgttgaagcaaagccacactgcggactcaagctcaaacgctctaagggcacgtattggctggcttctttgatccgggcaatcaagctttctttctcttccagagccccatttttacttgtgactagaccgagaacaactttctttgtttctgggacaaatcgcaatggctggaagtccccagagcgatcatcatcaaactccaagaaaaaggcttcgaccgcttcatgtcccaacagcgaatccgcaactggctcatagcctcccgatgccgcccatgtcgaatggtaattgccacggcaaacatgggtagtcacgtgcaggtcgttaggcagatccaccaatgcactgttattcaaccgcagatacaattcttgtaatttttgtgtatcatactcatcgttggtccttgactgccagtaatttttgtccaccagcatcccccacgtacagtcatccaattttagatgacgacagccaagatcatacaaggctaaaatggtttcacgataggcttgcgcaatatcagcaagcaatacttcccgatccggatagatagcgttcactttttcttcgttgctgcctcgaacaagttcgacaaacaattgagcaggcgctgggatactctggcgaacaggcaccccatctgcttgagccgcgacaaagcgatattcctcaaacacgggatgttctggattgaatgcgactttcccagctaatcgtgcagaatcagcacgggtttcttccccatggaacaagtagccttgatccatcaaaatatgctctattccttgaaatccccagaaaaaatccaagtgccaataactacggcgaaattcgccatcgctgacatatttcaagccaacttctttttgttttgcgactaactcactgatcgcctgatcctcaacttcttttaactcggatcgagtgatttttccttcagcgaacgcttcccttgcttgcttcaacttctccggacgcaaaaaacttcctacaatttcataatgattgatcacttggcacatagtttctcctccttttttgggtaaaaaaaaatccttaagagttatctcttaaggatgtaataaatttacatggtaccaccttagtttgcatccgacttacgaagaatgcctctactccaatgcgacgctgttgcgtgatattggggtctcagtaacggggacatccgtgcgcttctaaaacttgcgttctcgaaacacccactcaaaagccattttcagattcgttttctttcaccctttttcagctgtcggggctctctgttagaaattccacagaatcttactttctttttctacgtgtttacttattgatttttaacaaggatagcagaatgattttagtgtgtcaatattgattttaaaaaaaagaagcattgctgcttctttcttcgtttaatccacataagttgattttgattgattgagccatgcatagcccagacccatgatcaagccgccaccgatatagttcccgataaaggcaaagacaagattgtgaatcacgctgccgacagtcataccagctaagtggccgccagatgcccagaaagctaacgtaaacgctgggaagttagcgatgacgtgttcatagcctaagaaggcaaagataaagataatgaaaataatcgcagctactttccctgcatcatctttcatccgcatacttactaaaacagctgtattaacgacaatgtttgcgaacattgcttcgacgacgatttggagtgtcggcttatcaagttttgcggtaatggaagtcaataagaaattatccgcaggcaacccttgaaaaggtccagtcaaagaaataattgatccaaaaatcaaaccaccgactaaattgaagagcacacaagtgaacaaaatcttcaatgccaaaggaacactcaatcgtttgcgataaacaccgacggtcatatacaacatatttgatgtgcctaattctgcgttcatatataagatcatgacaagggaccaactaaacataaatgcatacaacatttttcctagtccatgtgcaatgtcctcacctttcatagcaatcgcaaaggcaatcgctgttcctagcgtcaagaaaagacatgccatcatggcccgtacagcatagcgtaaataactgcttttgatcaaatcgaccttcttttcaatggaagaatcaattttttcaaataatggggatactggattcatttttctgctcctttttatgggtatgataattgagttcgttataaagtacacaataccttcacattttaataaccaaacgcctatttgtaaagtgttttctgaaaaacgttactttttatatgaaattttcatcacattttcattgcaattgaattcaatcataccttgacttttcctcttattttatcgtatactgttccttgtgtaaaataatgcagcagggaaataacagctcgtcaccagttcgttgcctaaaaggttcaattgcgtaaccgcggctgcaaaggtgaagattgaagaacgaactgcacggatgtgaatttttcaacggattattttactccaaactatatttattggaggaactaaattatgtctcgttatacaggaccatcatggaaaatttctcgtcgtttaggaatttctctttcagaaactggtaaagaattggcacgtcgtccttacgctccaggacaacacggaccaaacagccgtggcaaaaaatcagaatacggtatgcaattgactgaaaaacaaaaacttcgtcatatgtatggcatgaacgaacgtcaattccgtacattgtttatcaaagcaagcaaaatcaaagaaggtaaacacggtgttaacttcatgatcttgttagaacaacgtttggataacgtcgtttaccgtttaggtcttgcaactactcgtcgtcaagcacgtcaattagtaaaccatggccacattttagtagatggcaaacgtgtagatatcccttcttaccatgttgaagttggtcaagtgatcagcgttcgtgaaaaatcacaaaacatctcaacaatcaaagaagcaatcgaagcaactactggtcgtacagcatttgtaagctttgatgatgaaaaattagaaggttcattgactcgtttaccagaacgcgatgaattgactgcagaagttgacgaagcactagtcgttgaattctacaaccaaaaactataagaattttcaccagaagctgcgacagaaatcttgtcacagcttctttttttataaattgttagaaataacttcttcggaaagaagtcaaaatttcacagaaatccgacaagcaattttcgaactctccttttcatctctcttgaagcagactacttctgacatgacctcttttttgagaaatcaaaaaaactgtgctggtttcccgaaggaaataccacacagttcgcgattaatcggcaggtcgacttcaaataatattgacgacggactctccggatgaatttttttgatgatagttgaacaacagcaaatctttctgacgctttttaaagattactttccgaatattgcgtggcacaaatttgcggatatcatcttcattatatcctacttgcagtttgtcgccatcaacaatgatgggacgtttcaataaattcgggtattgctcaatcaacgctaataattcttctaatttcaagtcatccaaatcaatggctaatttttgatacacttttgaacgtgttgagataatatcttctgtcccgttttttgtcaaagaaagaatttccagtagttcatcactatttaatggatcgctaaaaatgtttctttctttgaagggtagttcattttcggtcaaccaagcccgcgctttgcgacatgatgtacagctaggcgttgtgtatagtgaaatcattgatcattcttcctttctgatttttctgcggattcttattgattatctgtgattttttcgatcgtttcttgtttgacgacatccacgatgcgaatgttgatttctttgacttctaaagcagtcaaccgactaacttcttgcaaaacaatttcttggatctgagcaaacaaccggggaatatccttcccgtaggcaacaataacttccaaatcaattgctacttgttctttgccaacttccacttcgatccccgatgtcacattgctctggtcggccaaatcttccgtcatacttgaaaaaaattttccatctgcactgattaagccatcaattgacgccaaggctacacctacgatcgtctgcaagactttctcctcaaaggtaagcgaagcagtctctacatttgccgcttgttcattttccatttttcacactccttgtttgcatttctgaaaaaagaacgttttttttagtaacagatccaccaaaaccaacaaccttttgcggttatctgccaccataggtaaaaataccctcctctattagcatagaagttttttgttttttttacaaagaaaaacacttgttaccggatactttttttgcaaattaccgaaataaggtacgtttttttaatataaaaaagcgattccagaaaatattttcctcgatcgcttcttatattttatctgatttatctaaaaagattcttcctcaatcctaccgctcattcaaccttgtatagctccggtcagaagacacttccttataagctggtcgcatgattttttgggcattgactaattcttcgattcgatgagcagaccagccgacgattcgcgcaatcgcaaacatcggtgtgtaaagttcttctggcaagtctaacattttataaacaaagccgctgaaaaaatcaatgttcgcactgacgcctttatacatttttcgtttttgagcaatcacttctggagcgattcgttcaacagttgtgtaaagttgatattcttgccaagcgccgatgcctttctcttgtgcgagtttggctacataatttttaaaaattgccgctcgaggatcattgtcactgtagacagcatgtcccataccatagatcaagcccttgcgatcaaaagcttctttatccaaaactgcttctaaataacgacgaactgcagcctcatctgttgtatcagcaatctggcgtttcagatcactcatcatctccgtcactttgatattggctccaccgtgtttaggcccttttagcgaccctaatgcggctgcgatcgtcgaataagtatcggtaccgctagaagtaactacccgagtagtaaaggtcgagttgtttccgcccccatgttccatatgaagcaccagcgccatatccaaggtttgagcttcttgaaaactataggctttattaggacgcagcatggtcaaaatcgtttctgccgtgcttaattcctccgaagggcgatgaatatacatacttccctcttgattgtagtgattataggcgtggtaagcgtagatcgccagcagtggaaagacactgatcagcatcaaactttgctctaatacattctcaatactgacatcatcggcttgcggatcataactggctaatgtcaaaatactgcgagataaactattcatgatatccgcagaaggtgctttcatgatcacgtcacgaacaaaattggttggaagcgtacgtttatccgccaataactgacgaaatccctgcaattcagataactttggcagctcgccaaaaagtaataaatatgcaatctcttcaaaaccaaaccgattttcttcaacgaatcctgcaaccaattcattgatatcgattcctcgataacgtaattccccacaagcctcgaggggcttccccgccacgattttttctggataaatggtagaaatggttgttaagccggctaagacgccttttccatctaaatctctcagtccacgttttacgtcatactctgaataaagattcatatcgatttgattgtgtttctgacacaatgatgaaagatatacgatattcttttctttttctaatttttccacagccatgttacctcctaacatccttacgtaaacatgctactaacttcatttgattcaaaaaataaaaacttttaaacattatagcacgatgtttataaaatgaaatatttttcataattttaattgatttttctttttataaacgtataattattcctaatagattgatatttaaggaggatgcttatgaattggcacacaaacctgatcgtgaatgatcagcgctatacgtttattgatttagcaaaggtcgcggctgactttaacgctgatttaaaaagattgccttactcgattcgcgtgttactagaaagtgtcgcccgtcaccaagatgaagagattactgctgtttacttggattatttggtcaattggaacgctgaacagcccacaggcgtcgtacctttcaaacccgaacgtgtcgttttgcaagacttcactggtgttccagcggtcgtagaccttgctgcgatgcgagacgccatcgttgccttaggtgggaatgcagatacgatcaatcctgagattcccgtgactttggttgtcgatcattccgtccaagtcgattgtgcagggactccggaagcagtggctttcaatacggcgcgtgaatttgaacgaaaccaagagcgctaccaattcttgaagtgggctcagggttcatttgacaattttgaagtcgtccctccagagaccggtatcatccatcaagtaaatattgaatcactttctgatgtgattttggaaaaaaaaatcgctggcgagtcgtttctttttccggatacattgcaaggaacagattcccatacaacgatgatcaatggtctcggtgtattgggctggggcgttggcggtatcgaggcagaagcagcgattttgggcgagccgtcatttttcccgactccagaagttatcggtgtctgttttgtgaacgaaatgcctgccggtacgaccgcaactgatttggcgttgactgttactgaagtcttgcgaaaggagcaagtggtaggaaaatttgttgaatatttcggaaccggttaccaacggttaagtttagctgaccgtgcgacccttgccaatatggcaccagaatatggcgccacttgcggtttttgtccaattgatgaagagaccctcaactatttagctactacgggacgaacacccgaattgatccataaggttgctgcctacacaaaagccaatcatctcttttatgatgcgacggagataccagactacaccaaaacgatcaccatcgatctagccaagatccagcccgcattggcaggaccaaaacgaccacaggaccgtatcttattaccggaagttggcactgatttcgatcgttccctcacggctgacatcggaccaaaaggcttcggtctttcggagaaggaatggcaaaaaagcagccaagttaactggccaaacgagccttccgaaacattgcagacaggagatatcgtacttgcagctatcactagctgtacgaatacgagcaatcccttcgtcatgctctctgcgggattgttagcaaaaaaggcggtagaaaaaggattgaccgtgccaaaatcggtcaagacttccttggcccctggttcccagatcgtaaccacctatttgactgccagtggattattgccttatcttgaacaattaggcttttatttagttggatacggctgtacgacttgtatcggcaactccggtccattagaagcacccgtagcagaagcaatcgaaaacgaaaatttactggtcgcttctgttttatctggaaaccgcaactttgaaggtcggatccatccacagatcaaagccaattatttagcttctcctccgttagtcgtcgcctatgccattgctggaaccatccggaaagatttgacgaaggagcctctaggcgtcgtagcaggacaagaaatttatctgacggatatctggccaagtaacgaagaagtcaatgaatatattcaagcttttgttggaccagaagcgtttcgtgcagcttatgcgcatctattcgacgccaatgagcgttggaaccgtatcgatacaactgccagtgattgttatgcttgggaggacacatcaacatatattgcccacccaccctattttgattccttgaccaaagaattacctatccaaacaagtttgtctgatttgaaagtgttagccaaattgggggattctgttacgacagaccatatttctcccgctggtagcattggattagattctcccgccggcaggtttttgcaaaccaaagctgttccttaccgtgagttcaactcttttggttcacggcgaggcaatcatcacatcatgatgcggggaactttcggcaacattcgtttacagaatcagctggttcctggaagtactggcgggatcacccattattttcctacaggggaaacgatgtcaatctatgacgctgccatgaattatcagaaaaacgaacagtcttgcattattttagctggtaaagattatgggatgggttcttcccgagattgggcagctaaagggacccaacttttaggcgtcaaagtagtcttggcagaaagtttcgaacggattcatcgcagcaatttggtcatgatgggtgtgattcctctagaatatcttgctgggcaaactgccgcttccttgggattggatggctctgaatccttctttatccaactgcccgaagaaccgcaggtcaatcagcagattgatgtgacagccaaacgtacagatgaaacaatgatcacctttccgactcggctgcgtttcgatgcaccagcagatatccgttactggaaacatcaaggaatcttaccaatggtcattcgcaaaaaaatagaagcaggaggaactagcaatgcattctgaagcgtccttatctaacactgttctcacaattccttatatcagtggtgacggcattggtccagaaatttggcaagcagcgcaacctgtgattgatgcggccgtaaaacaagcgtatggtcccaaaagaaggatccactggcaagaagttttagctggtgaaaaagcatttagacaaaccggcgaatggttgccgcagtcgactcttaccactatccaagaggctaaaatcgcattgaagggaccattgaccacaccagttggcaaaggattccgatccctcaatgtcacattgcgccaaacattagacctctatgcttgtgttcggcccgttcgatactttgccggggtaccttctcctttgaagcatccggaaaagacgaatatggtgattttccgtgaaaatacagaagatgtttatgcaggaatcgaatttgcaaaaaatgatcccctcacgaaacaattaattgaggtgctgcaaacacaattcagtgtcaaaaacattcgctttccagaaagcagcgccatcgggatcaaaccgatctcaaaagagggcagtcagcggttgatcagcggagcgatcgagtatgctatcgcacaccacttgccgtctgtcacccttgttcataaagggaacatcatgaaatttaccgaaggcggcttcaaaaattggggctatcaattagcggaaacgaattatgccgatcagtgcttcacgatgaaccaatgggcaacaattaaatctgagcagaatattgaagcggctcaagcagcacttgctgctgcacaacaagccggaaaagtcattatcaatgatgtgatcgcagataatttcctgcaacagattcttttgtacccagaaaaattttcagtgatcgcaacttgcaatctcaatggcgactatctttccgacgcattagccgctcaagtcggcggaattgggatcgctccaggtgcaaatatcaattatgtaagtggtgccgcaatctttgaagcaacccacggtactgcccccgatatcgttgacacaggaaaagccaatccctgctcgttgttgctctctgcttgtatgctcttggaatatatccagtgggatgaagcagcagttcttattaccacagccatcgagacagcaatcaaggaaaagaaagtcacaactgactttgcggcagctatgactgacgcgcattgtttgtctaccaaagcgttcggtgactatctggtcacattgatcactccataatcattcaccgctctcgttgacttgtcattttagacaactcaacgagggcttgaatttttttgagacaactcaacgaaggcttgattgtatttcagttgctagttcccctatactggagacacgaaaggaggagttcacatgaatgaattcaacatacggcaaatcggccaacggattgccagcaaacgtcgagaactaaatatgactcaaagcaacttagcagatcaattattggtcagttatcaagctatcagcaattgggagcgaggcaatacattgcctgacatcgaaaaattgtcccagctagcaacaattttgcagttatccattgacgaactattaggaaatagcggagttgcagtaatgcattaccacgagggagtcgccgattctcaggaaatcaccacgttggcgccgatcattaaacctaaagaattggcagctgcgactcaagcccagccttttgaacttgagttagtggagcaattggcaccttttttgagcagtgaagaattatttgctttattgaaacctataacagaaccgctgaccgaagaagcactagaagaatttttaccttttttagagacagatcatttggaacaattgatgaaagaggactatactttcgcttttctggaagaagcagcgccctacttatctgccactttcttagcccaaaaagttgagcagtctgtctcaaactcgctgtctttgtacgagttggaagatattgccccttttctcgaaaagcaagatctaggacgcattcttcaaaagatcctggcagcgtcagagaatccggagcaacggttgtcagagcttgaagacctgctaccttttctcgatgaatctacgttagtaacgcttgtcggatactttcctgtaccctctgaggtttttgaactgtttaccccttttttggctacagaaactttgttgcaagcgttgcgaaaaaaacgttgatttactctttacttttcgttaaccaagatttataatttcgttaaccaactattggattatgtgttaacgaaagaaggatactatgaaactaccattgcgagaacaaatctatgctgctttttttgccatcattattgctgggctgtctcaactaaccatcccattaggattgattcctctgacaggccaaacctttgctgtcggcttggcggtaacctttctaggaatgcgcacagggaccatgtcgatccttatttacttattgctggggttgatcggattaccagtttttgccggcggagcaagtggcatcggcgtcttattcggacctacaggcggctatctgattggttttatctttaatggactcttgacggggaaacttttggaaacaggccgcgccggatatgtgagagggatgttagcgaatatcgctggtgcattagcaacattgttttttggtaccttatggttaaaatggagcaccgctatgtcttggactgctgccatcaatggcggttttgttctcttccttctgcccggtgtgatcaaagccattgctgcggcttatttagggattttcttgcggaaaagattgcagcggtaaaaaaagagaaagtagcaaacgtggactgcttcaagcaataaaaaggaattgccgaaaattgctgctttatttttttgaaatttctgcttatttccgaagaagctactgttagtcgtttattcgaaaaaaagagggactgtgccataagtcatcatccaacaagttaaaccgaataatagtctgttgctaggatagattcctctgacttttgcgacgaggagtccctgcaccgcaggagcaataatcattaatgttcggatagttttacttgtaggagacttatgacacagtcccgcacgcttttatctcgtagcgaatcaatagttgatccatgtgattgcttgctggagctctgctcttaaatgggctgctttgtattgattgaacgctgcttgattagttcgcaaaagtccccgtagctttgttggctgaaaattttctgtcaactgattttccagaacaaatcgtcgggtcaattgccattcatagtaatagcccaaaggacgacagctataaatcgtctgtccaatcacttgatcttcaaaccgacgatgggtatgaccaaagactacttgacgcacattgtccgcctcatcaataactgccccaaattctggtgaacctagaaacgcgttcaaatgattccaacgaacatacttccccgtttgtttgacgataaaggttgctttcggaacaaaatgagtcgttacgatgacttctttatcttgagggagccctcgcaatgtttgacgcagtctttcattgatctgatgactgatttccggatcggttcctgtccgctgaatcatacgatcataccaaaagaggcgcttgagacgaaggatctcttctgtgctttgcaagtcagaatagccgtagtcataccagccattgacacctaacaagagtgttttttccgataaagcgactgtttgaaagttcaagaaagctggatcaggataggtttcgatcaatgattctgataaatcagccatttcatgattgccccaatgaaaggtagtaggcagctgtctttgaaagaaatcaatgacggtcatcgctgctgtctctttgtttgcaatatctccagctagatgcaagtgcgtcgcttgattggcgtctagcaattcggctatcagctgcaagtctgttgcactgaaatgattgatatcgacatgcaaatcgctgataacggctaatttccccatatcagtttcctgccacctttttgtccatgcgcaacagttgaacgttagatgccagcagaccgctgtcactagtcaactgcaagcgctgatagtcaggatcgaccaccaagcgtgtccgctcttctaaatacattgctgcgccttgttttaaccaaactgttccaattgctgtatccagcttcgtatcatagatagacaatccttcttctggataatctgctggtacgaggatcaagcgaaaactaatatctaaccggcaagagatcgccgtagccggaaaaggtcccacaccatcttcaaaatctagataaattcgatctccctcctgtttgacttctgagatttttgctactgctgctgcatccatatcaatcgttatttccatagcgattctcctttacatgattcgtttttgccactcgtctcgggtaattccccgcatcacttcgtccactacttgcccacgaaatcttcgcgcagccggaatctgtgcttccactttcatgccaattttttccatcacgcgaccagatcgatgatttcgctgatcgtgcagtgcataaatacgaacaagcgctaatttttcaaaacccaaagacaaaagcatccgagcagcttccggtacgatcccttgcccccagaaagctttattcaaggtatagcctagttctgccacttcctttagcgggtccacccgcaagtcgatcgttccgatcatattgccactcattttctcttcaatagcaaatttacctaatggcgccgctaaaaaatacattgcaatggcgatttttgtatccacaagtgattgatgcctcggaaaaacaaactccgtcgtttcttcatcacttgcgtattcgaataaatcattggcatctgccatcgtcacaggacgcaaccataatcgtggtgtctcgattcgttgattttctgctaaaatcaataagtggttcttttggatttccatgtttcaccagctttctttctgatcttttttagtctttcttatgacctcattgaaatagctaaatgtttctaataatcgacgctcccttttttgtgctataatataaagcaagaaaacgcttaggaggattttcaatgtccgatgaattggagaaacgcctagatacaggaatgtacgggacacctcgtgttaatccagatgaacaaagaaaatacttgggaacgtttcgtgaacgttgttatctaagtatgacggtagcagaaatgaagaaaaaggacaaccaagaaacgttacagtcggttctccctaactatcaaggggcactgatcttgatcaacggaaaattgcccgaaacgcttcagacgacctttatttcattgattacgaaacaacagctcgattttcgagtggtgactgacgcccagactgctgatcctgacagtatcggtttactgatcgttgccaatgaggcagtgaatgaagaggtaatcgatatcgaagaaaagtatcctcaaaagacaaaatcatcttccgaagaagatcccatcaaagaaaaaaaaccattctgggaacgattcttccgctaaacaaaccaacggatcaattactagtgatccttcactagtacgaacagcaaaagaagttgtattagaaatggtcagctttaagatatttcggcttatttccgaagaagctacttctaaccatttattctaaaaaaaggaacagtgacaaaagccttgtcactgttcctttttcaacttctgactgttaagcggctgttaaaatcgttccggaaaaagcagcttgaggacagacatggttaagcggcggctttgtccttggtacgggtaaatatgcatatgcatagcgggattgaagttcgcttcaataatgccgtatgctcccggatcctccgtgggcttttccttgtcaggaataatcaaatcaatcccactgattcgtgcctgtaatgcggtaacggcatctgcagcgatttttttgtagtcatcattaaattgatcggtgacatcgatcgaatcgccgcccgtgctgatattggaattttcccgcaagtaaacgatttgtcctttttctgggacagaatctatgtgatagccttgctctttcaacatcaactgttccaattcacctaattggatcttctccaacggtgtccgatggtgggtcccccgtaatggatcggtatttttctctgcaactaattccttgatcgtgcgccgaccatctcctattacatttgccggtattcgtagcaaaattgcttcaacttgaccatcgatcacaaagaaacgatactctgttccagcaaggaatgcttcaactaaaatcgactggtcttcagcaaaagctaaacggacagcagcttgatagtcctccaacgaagcgccatccttaaagatcgagattcccacgccatagttggttgttttgggtttgacgacaaaacctctgtcagcaaattgcgggtaagcagcaagcgccttttctacagtggcgaattctgctcctgcaggaacccgaaaaccattctcagctaaaatcttttttgtgaccgttttattggccatgatcaaaggaacgatataacgatccttacttgtcatattagcgtttttgacatattcaacatgttcatcgatcgataatttcaagaactgatcagattcatccaacacttccaccttgattcccttttgaatcgcatcgaacatcaaaatttgtgttgacagttccatgttggtgaagcctgctaactgataaggtttttcccaggcaacttgatgataggatactcctagttcagttgccacttgagcctgacttgacctttggctggcttgatataaacgaccggcaaaagttttgccgggatcttccaacattggcagcagttgatccagtaaaggcattgtcggcagactgatttcctttgcaaaagcgatcaattcttccgcaactactttagcttcttcaagatagatcgtttgattcaatgggtgttccaatgccacttgattgtttttgcgatttccttcttcgacccaagcatcggcatcagcgccctcctctttcgttgctaagtataacaagaaaaggtgcagaaatttcacttgatcttgcgaaataccatacatttcaaagggattgatatcaatattgcgtaattcaatgtaacgaattcccgctgttgctaagtcggcaaccttttgcccccctcgcaggcgaactggtgcataaaactctttttcctcagatagtttgccagtttctaccagctcagcgatatccgccagataggtctcaagagaggcataagacacgttgacatcggtatgattcgtgtagccatagcggctgttacgaatgctgcggacaggttcttgcggtccagaacccgccataaaataattggcttccgtttgcggcgttgctccaaagaaataagtcaaaaaccagcagtaatgcaagtaatttcgggtaactttcaagtaaagttctgttttaaacctacgataatctgtttctgacgacttggtaaataactttcttaaaaaatcatccccaaattcaaaattgaagtggatgccgctgaccatttgcttacgacgcccatacgtccttgccaaaaaccgacgataaagaacatcttcaaaacgatccagctttgcgatcacgatatcctcttctttttccggcaacgcaggcggcatacttaatggccaaagcatctcctcaggtgccatcgaacgataagcaacatcatggatcgcagccagataacgaaatagttcctctgagctttccgcgactggcgtgatcaattccaactgattttcagcaaaatcggtttgtatgtacggatgaaaactacgattgcctaatgcttcaggatgatctgtcccagcaaaacttccgtctaaacgtgcacgctgcgcctcacgttcgatcccataacgcccatcaaataagtagggacgcagttcttcttgtataaaaagtgattttagtgtcatatcattgccctctttgtcttagattcttcttattatagtcaataatccagcagaaaaaaatgaaattgtgcgattctctttgctagttttttaaaaattaccaagtttttacaaattacttgaataaatttgatatttgacctctaaataaagtatacttactatataatagtaaattattatgtcaatattacaacttttttgaaaggaagaatagtgaatgaaaccactcaatcttaccaaacgcgaacgtcagatcatgaatatcttctggaatgctgaaaaacctttgtctgcaaatgacattgcggttcaacaacaggacttaagtaaaaacacgatccaagccgttgtccgaaaattaaagaaccatgatttattgaaagtagctgacatcggctacagcggtactgtcttgacccgcttgtattctccaaatgtttctcaagaagattttctagctgccgaactctctgaacaatcgttgctgaatctagtctcgaatttcattgaaaacagtgaggatgccgagacattgaatgatttggaaaaaatcatcaaagagcggcaagcacagctaaaaaactgatttctgaaacaagttgttcttgttcacagagaaatgtccacgctgaacatttctgacaagacaaggaatctttcttggaatgatttcaatttcaggaacagcagctacatccttttagctgctgtggggaggttttgtgaaccagaagtcacacgtcatctgttacgtattctgctgtggtacttcatgtacatcgcagctgtcaaacgtatgcctataaagtttatttccataaccgatgagctttatgcaagttccttaacaaaaaatatccgaactactactgattactcctaccgttaacgccatcgcgagatgatgaagaggaataatcaaacatagttcggatatttttgtcttatttcaagcgatgaacagcatcaaccttcgttgatgagacctttaaatagcccaacaacaaactcatttggatcaaacggctcaaggtcgttgattccttcccctaatccgaccaatttaaccggtaaacgcaattcattgcgaatcgctaaaacgatcccacctttggcagttccatctaatttcgtcaagaccaatcctgtaacatccgtggtttctttgaattgtttggcttggttcatcgcattctgaccagtcgtcgcatctaacacgagcaacacttcatgaggcgcattcggctctactcgttgaatgatccgtttgattttctctaactcattcatcaaattgactttattttgcaaacgaccagcggtatcaactaatagaacatctgcttgctctgctttcgctcgttccatcgcatcaaatacgacggctgccggatcaccaccagctttccctcgaacgacttccacacctgctcgatccccccaaacgacgagctgatcgattgctccagctcgaaaggtatccgcagctgccaacaacactttcttgccttctgatttgaattgatgcgccagttttccaatgctggtggttttaccgacgccattcacaccgacaaataaaatgacggtcaatccaggttgcatatttagttcgttgacttcgtcgacacccgcttcaccgtaaagatcgactagtttttcaataataacattttgaacctctgccggcttcttgacatttcgcaacttgacctcttgacgcagtgcatccgtgatcttgatcgctgcatcaaagcctacatcggctccaatcaatgtctcttcgacttcttcaaaaaaatcttcgtctacagagcgaaaattcgcgaacagctcattgagtcgttgcccgaaagttttgcgagatttcgatagtcccttcgtgtacttatcttgtacatcctctttgtgaaccgctgttggctgaggttgtacttcaggtttttttaccgtttcactaggtgtcacgacgtcgaatggttcagctgatttcagatcttgtgctccttctgatgatgaagtatcagccgcggactcctctgtttctgttggctgcaacgcggaatcggtagtagtttctggacgagaatccagtgttggttccgtcgattctactgtttgttcttgtgcggaatggtcatctgcgacggatgactcatcgacagatgactctggagattcaactggttcctctacttcgccttgcactttgtcttgctcttttgattcaccaatcaaagcttttttaattttgtcaaaaaatcccatttcaaacgcctcctttcaaaacatatttttcgatgacagttgctacaccgtctgcttcattcgaatctgttaccacatctgcggcttccttgattaaaggcacggcattagccatcgctacaccgagtcctgcatagcgaatcatcggcagatcattttcttcatctccgatcgccatgacttcatcgatagtgatacctaaatcccgagccagcaattcaatcccataggctttcgtaattcctttaggcataaattccagcaaattattccgagttttgattacttcatatttctctctgattgctgaaggaattgccaaaatcttcggatccagtacttcttgatgataagcaatcacagctttattatagagtttcgactcatccagagcttctatcgcatacgggcggcaatccagcaatggattcagcgaaccatagatcgactgattcgttgctgaagtcggcaagcacaaaacgatttcttcggatacgacatccagcggcaaatccagttctgctgcgacagcaaccaattcatgaatatcagccaattgcaaagcggctttttccatgatttctcccgtatcgtttttttgcaccagaccaccattaaaagtaatgctatagtcccctgattcattcaatgacaactcttctaaataaggacgaattgcccgtaaaggacgacctgtgcaaaggacgatttttactccttgtgcttttgcttgggcaagaacttctttatttttttgcgatacttgtttctttccatccagcaaggtaccgtctaaatcaattgcgactaatttgatcattttgctactccttcttgatctgcgacaaaatttccgccttctttgacatcttccaaacgcacagaaacggtcttagatacaccggattcctgcatcgtcacgccatacaacacatctgccgcttccatggtccctttgcgatgtgtgacaacgatgaactgtgtatcattttggaagtcgcttaaataatggccaaagcgtgatacattggcttcgtctaaagcagcttcaacttcatccagcacacaaaacgggacgggacggacttgaatgatcgaaaacagcagtgcgatggctgtcagcgctcgttcgcctccagaaagtagactcaagttttgcagctttttacctggtggttgggcttcgatctcaataccagtatttagtaagtcctttggatctgtcaaaatcaattccgcatgtcccccgccgaacatattggggaaaacttgcttgaactgcagacgaatcgcatcaaaaatctcaccgaaacgtgttttgacttcttcatccatctcggacattgtatcgaataattgtgcttttgcagaaagcagatcatctctttgactggtcaagaagctgtgacgctgttccacttgatcatattgctcgatagcattcaaattgactggtccaatcgcatcgatttttccttttagatcttggatttctcgttttgcagcttccgggtcatcgattgctggatagtcattggccgctttttcaaagctcaatgcatattcttcctgcaagtaagccaaccgattatccatcaccaaatccgcgcggtttttctcaatttctacattggtcttttcggatagtttttctttttgttgcaagtttgccaaactgagagcttcatccaactgtccaatttcctgttggacgatttgtctttgttgccgaatgtccgccaattcttgtgtcagtgttatttttcgttgagtaaaatcactgatttgctgatccaggctttcttccgaaatttcatggtcactcacattcgaattgattgctgctaactgccgttctagcgactgttggcgtgcttcattctccgctaacgcttccgcattcgcagcaattttttgtcttaaatgttccacttgttctttttgaacagcaaaatcagcttgtaattgggcggctgtcgctgctaactggcttctttttgcttcgattaaatcttcttctgcattcatgctttgaatgtcgtgatcgatttttttcagctgctgcgcaatggtttgctgttccgattccaaccgagtcttcttctcgttatactcttcaaaaaaggcctgaatctcgcgattttcaaagtcaaagacttgctgctcttttctcaaccgttccaactcgttggtgaggttttgcagttgattttttagttcgtgttccgtcattcgagccgtttcaccggtggttcgcagctcttccaaggctgcttgagcatcttttgtcaccgtttcgaagtgctgcacttgtttctctgttttttgcaggcgttcatccaattgaacggcttgagccgttaattgctgcaactcattgctttgactaaataggctgccggcatttttcttcgtcgctccaccggtcatcgaacccccggcattcatcacgtcgccttccagtgaaacgacacgatagctatagttcagcgctttagctaatgcattagcacttgtcagatcttctgcgatgacgatacttcccaatagattttcggcaatattttttacatcttcattgaaacgcaccagctcactagcaacgccgataaatcctggtacttgttgtgcttgagaaacagcataactaggtaattggcgagacttgattgtcgtcaacggcaagaatgtggcccgaccaccacgattttgtttcaaataggtaatcgctgctctggcatcacgttcggtttctactactacgtgctgggcagaagcgcccagtgctgtttcgatagcaactgtatattcttctggtacttcgatcaattctgcaacagcacccacgacaccggttagctgctgcttattttttagaactagtctgacgccttgataaaagccagcatagttttcttggatatcctgtaaactccgttgttttgcccgcacttgttggacttggttcattaactgatacatttttttctgtgcatcatcaaatttttctttgttctctttggctttctcttgtaaatggatatattgcttccgctgttcgtccaactgttgctgcacggcttgcaagcgttcattaacgatttctgcggctgtcgctttttctttgatcgctgtcgacagttctgtctgcttcgtaacggctgtttgattttttgccgattcttgctggtattggcgctcaagatatttgagctcattgccgaccgttgcttgctcctgcattgcttcaacatattgactgcgtaattcttcgatgatctctttggccgatttctgatacttttcttgttccgctcgacaatcagcaatcgctacttctgcctcttggacactgcgattcttttgcgacagttcatgaatcaattcagctttttcgtcattcaactgttggaggcgttcactgacggcatccaaggtctcttgatattctgctgtgcttttttgcgtatgcttggagcgctccaacagtacttctttttggccttcggcttgcttcagcccttccgttacttgcaacagctgctgattgagctgctccaatgattcatcgaaggctgctcgacgctgccgcaattgctgcacactgcgttcatcggtattgatttgctgcgtgatttcagccaactgatgatttaatagttccagctgttctgtagctgtttcccacgcccgtttggctgtctggatctccatgacagaaaaagccacgtctacttccgttaatttttccttcaatgacaaaaattgtttggccgcttcactttgagcagctaacggaatcaattgatcctctaactcataaataatatcttgtagacggttaaggttgtcttctgtttcaaacaatttctgttctgcttttttcttacgctgtttgtatttcaaaacaccggcagcttcttcaaaaataccgcgacgatcttctggtttgctgctgaaaatcgcttcgactttcccttgagaaataatcgaaaatgattcttttcctagcccggaatccataaagagttcctggacatctcgcaggcggcaactttgtttgttcaaataaaagtcgctttcaccggttctccttaaccggcgagtcacactgatctcactgtaatccattggtaaatagtgatcggtattatctaaaataatcgttacttccgctacatttaatggcttgcgagtgtcagatcctgcaaaaatgatatcaggcatcttgccaccacgcaggcttttggcagactgttctcctaaaacccaacgaatcgcttcagtaatattgctcttgccgctgccatttggtcctacgaccgcagtcacactattttcaaaatcaatgatcgtgcggtctgcaaaggatttgaaaccggcaatctctattcgttttaaatacactccgccattcctttcttattgatcaagacttgctaaggcattttctgccgctgcttgctctgataatttctttgattttccttgcccctcgccaatcagcacatcgtcacaatagacttctgtccaaaagattcgttcgtgggcaggaccttcttctttcgttaaacgatagttgatggacacatcgccagatcgctgcaagacttcctgcaatcgggtcttgtgatccatctcatgggaaaaagcacctgcttttacttttggaaaaacaacagccgtcaagaaaccgtcgacgctctccaaaccttgatccaagtacaacgcacctaaaaaagcttcaaaaagatcgcataacaatgagggacgcttacgtccgccagagttttcctctcctttgcctaaccgaatatattgatcaaaacggcaatctttggcaaacattgataagctatcttcgcgaacgattgctgcccgcagctttgtcaacttcccttcaggaaggtccggcagttcacggtacaaataccgtgagacgatcaattctaaaacagcatctcctagaaattctaggcgctcattatcggataggtgcaaattgcgatgctcattcacataagatgaatgcgtaaacgcttgttcgagtaaatctacatcatggaagacaatgccgtaatcctcttttaattcgttcattagctgtgtattcatttgccacattccttcattagtttatcgacacttccctattatactggtttttggctaattatgaaatgtttcgtccaaaaacttgaagcctccataaaaaaattttaaccgtttattctcctgctctttgtttccatgactgattcattgttttttattgattttgccgcgaacaaaataaaaaaagacgttcccgaaagaacgtcttttcctaaattagcgagattctgctgttacagaaactgttgcccatggattgtgatctgcatcatatgcccatgtgaaatctttgacgcgattagatactggtaatacttggttacggtaaagcgaaggaataacaaatgcttcatccgcagcgtattcttgccatgcatcaaatgcttctttacgttttgcttcatcaaatgattctttagagtcgattgcttctaatagcttcgtattttcatcagattcaaaacgagtgtagttaaatgctgattttggtccataaagtccggttggtgaaggatctgaacctgttccccatgcaccttgatacacatcgatttcaggatcatcatttttcaatttatcatagaatgcttggaaatcaatcaaacgaccagttgtgtatttcacatctaagccgatttcattccattgttggatgtagtaatcagccaatggttgagctgtttcgccacctgacattgaagcaaaattgatggttaatttttcaccgtttttgtcttcacgcatgccgtcgccgtcaacatctttgtaaccagcatcgtctaacaatttgtttgctttgtcgatatcttgtgtgtaacctttaacttctgtatcgtgcaatgttccaaataccggtgggatcaatgttgtcgcatttgaacgtaggccattatagaaacggctaccgacagcatcattatctagtgcgtaacccattgcttgacgcaatgatttgtccgccatttttgattcaggattgtagttaacttttccttctttatcatcccaagtacctaacttaaatccaatatacgtataagcttgctcaggacggcccaagatttggtagccatctgcatctttgtaagttgggtaagtatctgttggcattgacaatgctaaatcatattgcttcgcttttaaaccttctacgattgaagctgctggaactgctttaaatgacaatttatccattttaggtttgccaccgtagtaatactcatttggtacgtattctacagattcaccggctacgatgtttgacattacgtaaggtccgaaaacgattggtgttttacgaacaggatcacttgattccatatctttgactgcaataccttcaaacgcatgttttggtaaagcagaagaccagataccgccgcctgcttgcatcataccagggtgaacttctttgtattgaattttaacgactttgtcgctttcttttgtgattcctgagattgtgtcagatttgccatcgtggtaatcttccatcccaacaatatttgtaaagttgttgtcataacggattcctgtgtaatctttgttaccgatcacttcataggagaaaatcacgtcatctgctgttacatcttcgccgtctgaccatttcaaattgtcgcgtaatgtaatcgttgctgtgttattatcttcatctaatttaagatttgcagccccaccatcaacaattcgaaaatcagcatctgttaagaataaactttcattacttggttgcatgaactgagaatcataattgtcttgataaaattcagtttggaacaaaccttggaattgtgtatccataactactgcgacgtccaatgtaccgcctttgattgcttctgcgtcatttttgacttcaaccggcatagagctaatatcttctgtttcagttgctgagttgctgccgcctgatgaatctgttccgccactattgccgccacaagctgccaatgctaagactgacaaaagtgtgaccataccaaaaatatttttcttcatcctgtatcctccttgttttaacctagtcgttgacgtgcatcggctgaacgcttaaatgcctgaccaacgtagtttatactcaacatcaatactaaaatcaatattgacgcgggtaaccatatccattgtctgttgaccagcacatcaccgctgctggcgtacccaatcaatgttcccaaacttggaacattcgttggcagaccaaagcccaagaacgttagagttgtttcgataccgatatttgctgcaaagttcatcgtcaagttggtgatgatcaatgagcttaagttcggcatgatttcgcgaaacatgatcacaaaatcattggtccctaatgtttttgacgcactcacataatctcggcgcccttcagaaagggtcttactgcggaagagtctcgcttttccgacccaataaaaggcactcatgacccagataaacgtccaaacattgtagcgaggtatgatcgaaacaataacgataatgatcaacatgatcggtaagatcatgacaaaatcgacgatacgcatcaagatattatcaatcaacccgccatagtaacctgaaatgatccccaagccaactccgacgatcgatgtaatgatcgtgatggaaaacccaatcaaaatcgaattacgcgctccaatgatcaattgtccccaaacatcacggccaccttcatccgcccctaataggtaggtgccgccatttggtgagactgctcctggtgcagcatatttatctagaatacttacatgcatgacttggctttgatcaatgactgccgagccgatgaatacgaaaagcagtactgctaccaacaagaccaacgaaaaaatagcgatcttgtcttttaaaaattcacgaaaaatcatttgtaatcccataggtgggatactttcttgttttaacactttttctttcttttcagacacgtttatcccctcctactggattctgattcttggatcaacaatactcataatgatgtctgatagcaatgtaccgatcaatgtcgccagacctaatatcaaagtcaacgaagtgatcacggcataatcccgctgtacaatactatcgataaataattttccgacacctgggtaagcaaagattttttcaatgaccactgaaccagcgatcaatgaagtgatctcataccccatttgagatgcgatcggcaaggatgcatttcggaacacgtgacgtgagaagactttactagttggcacccctttcgaacgagcagttcgcacgaaatccaatgatttggaatcaatcacttcactccgcagatactggatcgtcacagcggtacctaatagcgcagaagtgatagccggtaagatcagatgatacagacggctccaaaactcagccattcccgttacgcctggtgctacagaccccccagttgggaaccaacctaaacgataaccaaagataaacagtgcaatcaatgcaaagataaacaatggtaccgcaaaactaaagaagttatacacgacaacgactttatctaaaatcgaattttggtaacgtccagccaacattcctaaaggaatcgcgatcacatacgttaagataactgttaacaaagatagccacaatgtgttgctgatccgtcctgaaagtaatgttgctactggtagtttatagataaaactttgaccaaaatctcctttaagtgcatttccgatccaacggaaatattgtgtataccaaggatcattcaatccggctgcttcccgcatccgttcaataactgctggatcttggttcggattaatcaatcctgtaaatggatccccgggcattgcttgtgcaatcaagaaaattaagacactcaaaataatgacttgcgggatcattaatatcaaacgacgtagaattgttttccacattattcagcacccccatttttcaaagcgacttgatgtgtttctgtgatggttctaaggtcataaacacgacctgtttcatcatagtaatctttttggtgagtgacatattccaactctacccgacggcggttttctttatgcgcctcacgatttttcacatcaatttgaggaatagctgacaataaccgcttcgtataaatatgacgcggatcttgataaatatcttggcgtgtaccgatttcaacaaaacgacctttatacatgatggcgatattgtcgcacatgtgtttcacaacacccaagtcatgagagatgaataagaaacttaagccaaactcttgttggattcgtttcataaagttgagcacctgtgcctgtacagacaggtccaatgcagaaacaggttcatcagcaacgatcaatttagggttcgatgccactgcgcgggcaacccccaaacgttgtctctgtccaccagagaattcatgagggtatttgtataaagcatcttctggcatcccaacgatatccaaaagccgtttcacccgttgtttttcttcttggtcactcaaacgttcaaaattccgtagcggttcagcaataatatccactacccgctttttaggattcagacttgacatagaatcttgaaaaatcatttgaacatccttgttgtaattcatttttttgcggacagagcgctttgtgacatcttgtccttcgtaaatgacttcaccgctggtaatcttttccaagccaacgattgctttccctgttgttgattttccagagcctgattctcctaccagaccgtaagtttttcccttttcgatgatgaaatccacaccgtcaacagcatagacatagtccgttacgcggttgaaaaaaccgctgcgaatcggatagtggactttcagatctttgattgtgattaattctgacatctacacttctccttcttcgtctctaaaatgaaaatgcttatagcaagtacagcgaactaaatgatctggtgcaacttcatgcaggacaggattttcttcgtggtcactagctgggatccaagggatacgagcagcaaaacggcaaccagttcttggcatgtttttcaatgaaggaacgacgccttcaatcacgtgcagttcactgtcttgagaatcttcttgtggaattgagttcagcaaagagcgtgtataagggtgttttggatttgcaaacaactcttccgctgtggcaacttcaacaaactgaccgccatacataacggctacacgatcagccatttctgccactacacctaagtcatgggtgatcaaaatgattcccgtttgtgtttcagcctgcaaatctttcaacaaatctaggatctgtgcttggatggttacatccaatgcagtggttggctcatcagcaataacaattggcggtttgcatgcgatggcaatggcaatgatcacccgttgccgcatcccaccggataattcgtggggatactggcgacccacccgtgctggatttggaattcctacttgatctagtaattcaagggcccgggcttgtctctgttccgcattcatatttgtatgataagataaaccttctttgatttggtcttcaatacgcatgagtgggttcaaagcggacaatggatcttggaaaatcatcccaatgtcgttcccgcgaattttgttgtaaagtgtttcatttaagtttgacaaattcaagtctttgtataagatttcaccggtgattttggtattgtttggatcatgcaatcccataatcgttgtagctaaggtactttttccacatccggattcgcctacgatcgctaaaatctcattgcgttccaacgtaaaagaaacaccgtctacagcgtcatagtaatcatctttaatacgaaaacctgtatgtaggttttgaacatctagtaattgattatcagttgacaatcgaatacccctctcttttttataagatgaagtgccctctaatgtaaaaaagtaggaattataagtcaaattccaaatgctttcttaacatcgtgtaatattttcttaataattatatagaatcactcactagattgcaagtctataaatttttaagatactgaattttcagaatacttacattccatttacattttttcaggatggtgcaaagaaaaggcactttttttcgagaaacgaatggttattaaacaaattctgataaagaaagagctgggtcatctatgactcagctcctgtatctgtcttaagcaagatggcttgaaatataatcaactgctccgccgactgtttcaatctgttcggcatcttcatcagaaatctccgtaccaaattcatcttctaattctaagacgaattccatcacactgattgaatcagcatttaagtcgtctttaatactcattgtatccgttactttatctgcatcgatctcaaaatggtttgcgatcactactgcaactttcttgaatacttcttctcgcgtcaattgccttcacctccacgcgttcgcacaaaacatagaatggctaacaaacattgtactgcttacatgcaaatttgtctagtccttttttgcattttcattacaatgattgcagtctcattgcgttggctcttcatgcttaggtgtttcttcaaaatgagccaccaattgaggaaccacatctgcctgcaacatggtatagatttgtttgatggttgctgccacggcatctggtccagtcgctccatgtgttttgatcactggtgctttcagaccaaacaagacagcccctccgtgtttggcataatccatctcattttttaaattgcgcaaggcatctttcaataataaagcccctaatttccctttggttccggaattcatgatggattgtttcaataacgacatcatattcaatgcggttccttcaatggatttcaagacggcgttcccagtgaatccatctgtgaccacaacatccgctgcaccgttcaaaagttccctagcttcaacatttccgataaagtgaatcgatgattctttggtcaacaattcaaacgcttttttggttaactcgctgcctttggtctcttccgtcccattgtttagcaaccctactcgcggttgttgaatgcctcggactttttgagcgtaaaaagaacctaacacagcatattgaacgagatgttctgctttattgtcagcattcgctcctagatccagcatatcaaagccagtttctttcccaagtacaggcatcgtcgacattaagccaggacgttcgattcctttgatacgacctacgataaacaaacctgcagctaacaaagcaccggtatttccagcagagaaaatggcatccgcttgaccttctttgaccgcttgggctgctaagaccatcgatgcgttctttttgcggcggatcgctttaacaggttcatcatcactgttgattttttcatcggtatgaatgattgtaagctgactttcgtctgtcacatattttctgatttcatcttcttttccgtataatagaaattcgatttctggatattctttttttgctaacatgacgccttcaacgatcgcttttggtgcgttatcgccacccatggcatctacggcaattttcatgacatacgccactcccttcatttttccaagttagtataccatattctttaatcaaaaaattgattgtctcgtttttctgctgctaaataatcggctagcgcttgatactccggtaaaatctgccattggtgcttctgccagatttgagttgcttctacttgtgcaacttcaagaatatgggcatcggctactaaatcggctgcggcgaattcaggtaaacctgattgacgattaccaaagacttccccgggacctcgcaattgcagatctttttcactgacgacaaagccattggtggtttcagtcatgattttcatccgctctattccggtttcatttttgggatttgccaccaaaatacagtaagaagcatctgcaccacggccgacacgcccccgcaactggtgcaactgagctaacccaaaacgatctgcatcaataatcaacatgactgtcgcattgggtacatttacccctacttcaataactgtcgttgataccaagatctgtaactggttgtccttgaactcttccatgatcgcgtctttttctatatttttcattttgccgtggagaatgcccacttggtagttaggggcaaaataagcctgcagctgctcgtaaatctccgtagcattcttgacatctaacatttctgattcttcaatcagcggacagatcacatacatttgatgtcctttcgctaattcctgacgagcccagtccagcacagattccaattgaggtggtcgtacccaacgcgtttcgaccggaatccggccagctggcatctcatcgatgatggaaacatccatctcaccataggccgtgatggccaaggttcgtggtatcggcgtcgccgtcatgaacaaaacatccggcaaatatcctttttctcgcaatatttttcgctgattgacaccaaagcgatgctgctcatctgtgatgactaaacctagacgggcaaaattgaccccttcttggatcaacgcatgcgtccctacgacaatatcgatctcacctgcagccaattgctccaagatcactcgccgttcctttgtcttggtggaccctgtcagcagtgccgttgtcacttctagcggatcaaataactggttaaggctttccaaatgttgttgtgccagaatctcagttggtaccattaacgccccttgaaagccagctgtcatagtggcgtacagtgcgatagcagccacaactgttttgccgctaccgacatctccttgcagcagtcgctgcatatgttgcggacttttgaggtcatgacagatctcgttggtgactcgcttttgagcagcagtcaattcgaaaggcagtgtctgggtgaaagcttttaaccgctgaacatcatagtcaatggctaagccgttcttttcagccttttcggaaattttcaatccttggatctgcatttgaaataggaagaactcttcaaagatgattcgccgctttgcttgatgactttcttgcggatcttttggaaagtgcatagctcgcatagcagtctggcgatccaataaccgatatttctccgttaaagttagaggtaagatttcctcgatctggtctccgtatgattcaaatgcctgcctgatcaagtcaaccagcacgctttgccgtaccgatttgtttacatgatagataggagcgaaatcacctggcttcttgctgccaagaatcttcatcccagctagtgatttccgtttcgcatcccatttcccgtaaaccgcgatttcttcagacaaaacaactttatcttttaaatagggctgattaaaaaaggaaacattgaatacatcatgatcttgcatcattcgaaactgcagccgactctttttgtaaccaaaacgatttacaacagccggggaaacaacgattcctttgatcgtgactttttcttgatcttgtatctcgttcaattgacgctcttgaatatcttcgtagcgaaaggggtaatatcgcaataaatcttcgattgtctggattccaagcgctgcgagatcttttgctcgcttttctccgacaccagacaaaacagtgattggctgatcaagcatttcttccctcctcaaaactagttgtttgcagattgctttctttattttactcttctctgtttaaattacgaagaatttgaatgaaaaaagatgagcaaaaacaggctgtttctctatcaatcaaaaaagagacggaaacaaaaatcgccctgcgacttttgccccgtctgctttcaagttttattcagccgagaaaagatacggataaacaggttgatctccttgatggatctccacttcgatctccggatagatttctgtcaatgctgcttcgatttttgctgcttcttttgcttttccttcttcgccgataataatcgtaacgatttctgtttcatctgaaatcatcttctgcaatgtatccatggaagcagagaaacaatcgggtacagaaaccacgattttcccatcaaccattcccaagaaatcaccttctgtgatttcaattccatcgatcgctgtattacgaatcgcgtgtgtcaccgaaccactgacaacacttgacaagatttcagtcatcgcttgttgattttccgctaacgttgcttgttcattgaaggccaacattgctgtcatcccttgtgaaatcgtacgggtctcaacaacagcgactgggatgtccgatacttctgctgcttgttgtgcagccataaagatattcttattgtttggtaagacgataacctgatctgcgttcacttcattgatagcagtcacgatgtcttccgtgcttggattcatcgtttgaccaccgctgatcacatagcttgcacctaagctggtaaatagtttatttaatccatcaccggctgcgatagcaatgattgcataaggtgtacgcggacgtttcactgcagcagagggttgatcgtgctccagaattgtttcatgctgtacacgcatattatccaccttgatcttgatcaaagaaccaaatttttggccatagttcatgacttcacctggatgttctgtgtgtacatggactttgataatctcatcgtcattgacgactaaaagagaatctccaagttcgtttagataatttcggaatgtttcataatcaaacgtactgtccactgttggtccttcaccaattttgaccatgatctctgtacaataaccgaatttgatgtcttctgtagccatttgtccttgaacgctgcgatgatgttcggcattgaccatttcatccattgctgctggtgttggttcatagacctcattggcttgatattctccagtcagtgcatttaagaacccttcataaatgaacaataatccttggccaccactatcgactacaccaacttctttcaagactggcaatagatctggtgttttggctagcgcacgttttgctccgtgaacgactgctttcatgacttctacacagtcatcactagtttgtgcttttttctcaccgtattctgcagcgatacgtgctactgtcagaatcgttccttctacgggtttcatgactgctttataggcggtttcgaccccatgtgtaaaggcttgtgccaattctggcgcagttaatgtttcgaccgtggggatcgctttagcaaatccacggaacaattgagacaaaatgacgcctgagtttcctcgtgcgcccattagtagtccttttgaaagagttgtggcaagatcgcccactttttctgaagtggcatctgctactgctttagcaccgcttgtcattgataaattcatattcgttcctgtatctccatcaggtactggaaatacattcaatgaattgacaaactctgcatttacttgtagacgagccgcgcctgcctgcaccatctcttgaaactgacctgcgctgatattcgttaccttcactgataatcctccttaaaatcatccgccgcaagcggatcacttgcctaatctggcagtacacgtacaccttggacaaaaacattcactgaatttgctgaaacgcctagcattgtttcaagattatatttcactttttcttgcacattgcgggaaacttcagaaatttttgtaccatagctaacgatcgtgtagacatccactgcaataccgttttcttcttgacgaacaacgacaccgcgagaatagttttctttgcgtaaaatttcattgatgttgtccttgatctgtttcttgctggccatgcccacaataccaaacacatctgttgctgcgccaccgacaactgtggcgatgacctcgttgctgatttcaataatacctgatgaggttttgattttcacagccataatatagcctccttaagcgggatattcccatctttcttctctcacattttatcatagctgctagtcaaataaaaggatgtgacttatgaaaaggggcttggcatcagatattcttgtattctgaccttgtttaatttacaatgtttactgctaaaagtcaatctttcttgaaaattacccttgcattttctaactttctatgataaattcagatggtatgagctgaaatagcgctccaacatcaaggcaaaggaggaaataaccacatggctaaagtttgttactttactggacgtaaaactacaagtggaaacaaccgttcacacgcaatgaatgcgacaaaacgtactgtgaaacctaacttgcaaaaagttcgcgttatgattgacggaaaacctaaaaaagtttgggtgtcaactcgtgctttgaaatctggaaaagttgagcgcgtataatcttaaccacacattttcggccgttcttgcgagcggtcttttttgttgtcttccgtttcattcctcctttcctttcttatgtcctttgttttttctttaaacagctaatgacattgtttttttaatcctttgaattatggtacactaataaaaaattcataaggattaggtgactattcttggctactatcaaatcattcatcaaacaacattggccttatatgaccgccagttttctgctgccgttactgattatggcagtcatttatttaacgatcggaatctatcccggcagcagccgcagtgtcttagcgagcgatgccttttcgcaattttcgaatttccatgccagttttcgtaatgtcttattaggcaagcagagtatcttctatacttggaatgcctctttagggttgaactatcttgcactgatctcttactatttaggtggtctttttacgccgctggttttattgtttcccaatcaattgatgccagatacgctctatgtgctgacacttttgaaaatcggcagcgccggactcgcattttggttttacgcgagtcaaacatttaaaatccaacggtggcatcatgttacgcttgctgtctgctatgcgttgatgtcctttatcactgctcactccgaattgatcatgtggctagatgcacttatttacctgccattagtgattctagggattgatcggctcttgcaacaaaaaaaaccgactcttctgtttgtcagttacctactgttatttatctcaagtttttatatgggattcatgatcggagtgttctccgtcttgtatctattcgtgcaattaggtcgcgattggaagcaaaacaagaaagcaatcatcccttacggcatcacttctttattagccggtggggcttccatgatcatcattttgcctgctgtacttgatttacgttcaaatggggaagaattgtccactatcacgaagttcaagacagaagctactggtgttttcgatcttgtaatgaaaaatatgattggcgtatatgatacaactaaatacggttcgatcccgtttatttatattggcctactgccattactactttgtattttatactttgtttctaagagaattcctttaaaagataaactgctatatgctggattgtttagcattttgatcgccagtttctatatcgttcccttgaatctcttctggcatgggatgcatgccccaaacatgttcttgttccgctatgcctatttgttctcctttctagtgattcttttggctggttatggttgggaacagctgcagcaaaaagaccgaggtctgtttgtgattgtcggactatctacgattgctctctttgcactttcttatggactgggaggaaactcgtatgaattcgtcaccacagcctcttttgcgttaacgattgttttctttgccctttacttgctgtgtatcggtttcggtcaacttggtatgctaactaaaaagaaagtggcacttctcttgttggttttcgtttgcggtgaaatggcgatcaacacgagtgggatggttcgcggaatcttaaatgattggaattacgcctctcgaagtctgttcactgatccttatccttcaatcaagcaattggtggatcaagccgataaagacaatgagacctttttccgtttggaaaatctggatcccgtttcttccaatgacagtatcaactatggttacagcggtgtcagcatgttttcttcaatccgcaaccgcaactcctctagttacttagataaattaggttttcgttcaagaggaacgaatcttaatatccgttatccgaataatacattgctaatggatgctttcaccggcatcaaatacaatattagcaaacaaaacttaacaaaatacggttttgaacgcgtaggagaagctggagactacaagctttatcaaaatagcaacgctcttccccttgccatgttagcagagccttcgatcaataagatccaacagcctgccaacgacaatctaaccagccagaagaatttgatcaacggtttggcaaacattgaacaaaactattttgattttcaaccgatcactgtcattcacagcaaaaacaccgatatcactgaaaatggcatgtacacgacattccaagagcaagaaagcaatgtggcgaaagagattacttggcaagtagaagtacctgctcattcccaagcctatcttagtctgtatccggcaaacttcggtgaattagagagttctacagctacgatcactgtgaacggggaacagcgggaaagtcaaattggaatcaatggtcaatattatgatctaggctactatgatacggcaacgaccgtgcagtttacggcaagtttctatggcactcagtcaatttctttccaaaacccacaggtggtgacattagacactaccgcctttcaacgggcaatcgatgccattcaagagagaggtgttgcgatgactgtcggcaaacaaaatgccgaagccgatatcactactgagaaagaacagcagcttatcactacgattccttatgacaagggctggtctgccaaactggatggcaaacctatcgctattgacgctttccaagatgcgtttatcagtgtgaagatcccaagcggtacccaccatcttgaactgacttatttaccgcaaggttttgtgatcggagtcattttattctttagctgcctactgctctttattttgttccgctatttctatcaaagaaaagtagcagctgagatagaacacacacccacagacaagccaggcagatgagagcaatcgataccttctttatctgccacaatagcagtcagctgcgaaaagaagcgccccccaacggatcgatacgaatcgaaccttaggaggcgcttctttcttttagttctcttttattcataggctacgcgaaccaaatacaacccttccggatgagcagtaggtccagcggcattgcggtctttttgggcaataatggcgggaatgctatctgctggtaagcgtccattaccgatcttcaacagggttccgaccatgatgcggatcattttatataagaagccatcgcctcgaaaggtaaagagtagttcgtctccggcctcattcacttccatactagcttggtgaatcgtccggactttatcttctacggagctgccagtggcacaaaaactggtaaaatcatgcgtacctaataaatcgggtaaagcttgctggattttcattaggtccaacggatacgggtaatagcttgcgtaatatctacgaaaagggcttcgtggtttgccgatatctacgcgaaattgataggtcttctcccgcacaagatagcgggcgtgaaagtgttcatcgacgattttcacctgtttcacagcaatatcttccggtgtttgtgtatcaagtccaaagcgcattttttctaatggacgttcgtcaaagtcaaaatgaatcacttgacctaaagcatggacacccgcatcggtccgtcctgaaccgtggatttggactgcttgtccattgttcatgcgagtcaatgttttttcgatttcttcttgtactgtgcgtccattgggttggcgctgaaatccttggaaattggtgccatcgtaagcaatcgttgctttataacgtaccatcttctcacctgctttcattttctcaaaaaaatctgaggagccgattgcactccccagacatttacttttatcctcttaataatactaaacctactgtaaagagcacaaagaccaacactacgagtgtgtcgcggttgtgccagtgaagaatccgatacttggtccgcccttcaccgccttgatagcctctagcctccatggctgtagctaggtcctctgcccggttaaaactgctgacaaacaaagggatcagcaatgggacgatagctttcatcttttgcaacaacccgccttctccgaaatcgactccgcgggcacgctgggcattcataattttctcagtctcatccattaatgtcggcacaaagcgaagtgcgatcgacagcatcaaagaaatttcatgcacgggaaatcggatggcttttaatgggcgtaatatatattcgattgcatctgacaactccaaaggtggtgtcgtcaacgtcagcaatgtcgacataaaaataatcaaaacaaaacggcaaaaaatgaacgcaccattctgcaaaccaaattcggtaatattgaagatccaccaggaccaatagacttctccacccgtcgtaaagagaatctgcaatgctacagtgaataaaatcagccagatcaacgggcgaacaccacgaacgaaaaaacccaaatcaattttggaaagaaaaatgctaaatagcgtaaaaacagctgccaaaagatagctctgccaattgtttgccaaaaaaatgattccaataaaataaaaactggcaagtaatttcacccgtggatcgagtttatggataaaggaatctcctggaataaagcggccaaagattagtttattcatcatttgcggtcgcctcctttgctaccagttgatccgcaagttcttctgctgtcaatggcaagtgttcgaaatgcaaccctttcgcttgcaacaacgctgcaaaagcagttgctgttggtacgcctaattgtttttcttgtagccattcgatatcttgaaaaacattcttcggtgcaccctctttaacgattcgtcctttttctaatacatagacataatctgcaaaattagccacatcatccatcaaatgggtcactaagatgatggtcatatttttctcttgatggagtcgctggaacatctccatcatttctttgcgtccttgtggatctaaacccgctgttggctcatctaataccaatacttccggttccattgctaagaccccggcaatggctactcggcgcatctgtcctcctgagagatcaaatggggaacgttcaagaaagctttcatctaaaccaacgagtttaatgtactctttcgctaattcagctgccgcttcttcactcacaccaaaattttggggaccaaaagcgatatctcgagccacagtttcttcaaacaattgcgattcaggaaattgaaagacgattcctacttttttacgcaatggttttaaattcttattatcagtttcaggagtgatcacgcgatcaccaatcgtcactttgcccgctgttggctttaataatgcattcaagtgttgtagtaatgttgatttgccactaccagtgtgacccaccaatgctgtatacgagccttctttgatttcgagatcaatatcgaataacacgcgttgctcaaatggggaatgcggttgataagtaaatgctactttttcaaaacggatgtccatagccaatccaccattccttcctctgtcaagtacgctgcaggcacagagatgccgcgctgcttcaaagctgccttcaatttttctggaaaaggcaaatctagacccaattcgatcaattctgggccagccgaaaagatttctgccggcgtcccttcacgaaccagttctccttggcgcatgaccatgacccgattggcattggctgcctcatcaatatcatgggtgattgacagaacagttaaattattttcttccttgattttcttgatcgttgaaataacttcttctcttccttcaggatcaagcatactagttgcctcatctaaaatgatgatatcgggacgtaatgccacaacaccagcgatggctactcgctgtttttgtcccccagaaagtctggctggttctcgtgttgcaaattcttccatccggacttgttctagagcatttttgactctgatcaccatttcgtcacgaggaatcccttggttctctagaccaaatgccacatcatcttctacagttgaaccgacaaattgattgtcgggattttgaaaaaccattccgaccattttacggatattccaaatattttcttcattaagcagcatgtctcccactgcaacgcttccttcttgcggtaaaatcaaaccgttgatcgttttggccaaggtcgattttcctgaaccgttatgaccgataagcgcaacccattctccttgctcaatggacaaagagacattcttcaacgccggacgatcttcttcggtataacgaacggtgatagcattcaattcaatgatcggcttcatgatatactccttcattccagttaattcttacttacactaccaaaaaagtaagttattttcaatcattccgatgagatttccaaacagaactttgttttcacttgccatgacctgtcaagacagatcatcgaaagtaaaaaaaaagcactttatgatgagtgcgtacacctcgaaatacatcgaggtgtaggcgctgagctagactcggaaagtttcttccaacatcataacactcttaataaacatctataaagtgatgataagtgtgattttaaacaagttctaggataaccattggtgcagcatctccgcgtcttggttctgttttcaagatgcgagtgtagccaccttggcgatctgtgtaacgaggagcgatgtcattgaataatttttgcaaagctgattcaataactacttcttcgttttcttcacgaacgctagcaacttcattacgaacaaatgcggcagcttggcgacgtgcatgcaaatcaccacgtttacctaaagtgatcattttttctgcagttgaacgaacttctttcgcacgagcttcagtcgtaacgatgcgttcgttaatgaataaatcagttgttaaatcacgcaacatcgctttacgttggctagatgtgcgtcctagtttacgataactcacgtggtttccctccttcactttcgtatgtcgtctcgatcagacgagccgaaactaacgtaatcgaagacgtattaatcgtctttacgtagtcctaaaccaagatcgtgtaatttcactttgacctcttcaagagatttacggcctaagttccgtactttaatcatttctggttcagatttattagtcaattcttgtacagtattgattcctgcacgttttagacagttgtatgaacgaacagacaagtctaattcttcaatcgtcatttccaacattttttctttttgtgtttcttctttttccaccatgatctcagcgtttttcgcttcgtccgttaggtttacaaagatgtctaaatgttcggtcatgatttttgcagctaaactcattgcttccaatggttcaattgagccatcagtccatatttccatcgttaatttgtcaaaatcatcacgacgaccaacacgagtattttctacttggtagttcacacgacgtactggtgtatagattgaatcgactggaagaacaccgattggcatgtcttcttttttattttcatctgcttgaacgtagccgcgtccaggtttcacagttaagcgagcatggaatgaagctccttcagaaacgttgcagatatacatatctttgttaaggatttctacatcactgtctacgatgatatcgccagcagttactgtagcaggtcctgtaatatcgatttccagggttttttcttcatccccgtacatttttaatgcaagacctttgatattcaagatgatttgagcaacgtcttcccgaacgcccttaacagttgagaattcgtgtaaaactccatcgatttgaatattggtgattgctgcaccaggtaaagaagataataaaatacgacgtaaggaatttcctaaagtagttccgtatcctctttcaagaggctcaacgatgaacttgccataatctttttcttcatcaatctttgcgattcttggtttttcgaattcaatcattcttatcttttacccctttcaaaacgaaaagtgtcttgttcaatgacgtaattgttacactcaaaatgagcagcactcattaaacacgacggcgttttggagggcggcatccattatgagggactggagtcacgtcacggattgcagtcacttccaaacctgctgcttgtaatgaacgaattgctgcttcacgtccagaaccaggtcctttaactgttacttctacagttcttaatccgtgttccattgctgctttggtagctgtttctgctgccatttgagcggcaaaaggagtagattttttgcttcctttgaaacctaatgaaccagctgatgaccatgctaatgcattcccatgagtatcagtgatcataatgattgtattattgaatgttgagtgaatatgtgcaatacccgcttcaatattctttttcacacggcgtttacgactcactttttttgctgccatgaagttttaacctccttcacttaggaattattttttcttgcctgcgactgttttagacgggcctttacgagtacgtgcattgtttttcgtgttttgtccacgaactggcaatccacggcgatgacggataccacggtatgaaccgatttccatcaaacgtttgatgttcaagttcacttcacgacgaaggtcaccttcaacttttaatttatcaacttcagcacggatagcatctgtttgttcattcgttagatcacgaacacgaacttcttcagaaacgccagcgtttgctaaaatttgttttgcagtcgtgttaccaataccatagatataagtaagtgaaacgaccacacgtttatcacgaggaatatctactcctgcaatacgagccatatttgttacacctccgattatccttgacgttgtttatgttttggatttgctgggcaaatcaccataacgcgtcctttacgacgaattactttacaatgttcgcacattggttttactgatggtcttactttcatgataatacctcctgtggttttacggagtacaattatttaaagcgataagtaatgcggccacggttcaggtcatacggtgataattcaaccgtcactttgtctccaggtaatatacgaatgtagtgcatccggatcttaccagaaacggtcgctagaacttggtgtccgttttccaattcgactttaaacattgcattcggcaaagtttcgacgactgtaccttcgacttcaatcatatcttcttttgccacgcacagtacctccttgtacttgtgattttcacacgataaaatggcggaaacggggttcccacctgatattctcaaactatgcttctacttaataacagtagaagtcggactgacatattttatcatactctgtcaaaggtttcaagagaaagttttgtagctgcaagtcggtgacgggcaatctatgattagtcaatgatgtttttaacatctttaaatacagcatcgatgtcgcgatcaccatcaatcgactgcaataaacctttttctttgtaataagctaagattggttcactgcttttgatattgacagctagacgatttttgaccgtctcaggcttatcatcttcacgttggtagaagtcatgacttccacaacgatcacatgttccttccacttttggcggattgaacaatttatgataagttgccccacaattgcggcacatgaagcggccggctaaacgttctacgagaacttcttcaggaacatgaatatcaatgacagcatctagttttttgtttaggtctttcaacatttcgtccaatgcttcagcttgttccaaagtccgcggaaagccatccaataagaagcctttctctgtgtctggttcagctaaacgctctttgacgataccgttggtgacctcatctggaaccaaagcgccttgatccatgtaagattttgctttcaggcctaattctgtttcgttcgccattgcagcccgaaacatatcgcctgttgaaatatgaggaagaccgtattcagcaacgatacgttctgcctgagtacctttaccggcaccaggtagtcccattaaaatgaggttcattctaattcctcctgtaagtttttgaatagtgttgaggaagacctcaacacttcaataactttaattgataaaaccagtatatttccgtttcagcataagtccttctagctgcttcgcagtatccagagctaccccgataacgatcaataaacttgttccacctaaaccgattgattgcggcaagttccaaaccatctgagcgatgatcggcaacagcgcaactagtcctaagaagaccgatcctactgtacttaatcgcataagcagacgtgagacgtattcttctgttcctttaccagggcgcacacttggaatgtagcttccttgtttttgtaggttttccgctaatttctcagggttaacttgtacaaatgcatagaagaacgtaaacgccacgatcaaaacagtatagatgatcgcaccaggtacggtgttataactaaaaatcgtttgtactacttcataccaagtttcgcctttgtacgaactacctaatgcttgaatgatcgcatttggtgttgtaataaacgaactagcaaagataactgggattacaccggcagcgttgaccttcaatggaagataactacttgttggcgcaccagctactcgcttcgtatattggattggaatctttcgttctgcttgttgtacatacgtcacaaatgtgatgatgaccaaaacagcaacgacaagcaagaccataaacaatgcattcatccaaatatctgatggatccacgttgatgaaataatcttctaccaattccttgatactagcgggtaagcgtgaaatgatccctgcaaagataatcattgacacaccatttccaattccgcgttctgtgatttgttctcctaaccaagtaacgagcatcgtacctgctgttaagatcaaaccaatcaccacaaacgtcgagatatttggattgttgacaaagccaagttgtgtataatagttgaaccctgcagttaacgtcatcgactgaacaaaggccaaaaccaatgttaggtaacgagttgcttgattcaatttcttacgaccaacttccccttgcttcgaccactcaacaaatcttggcacaatatccatctgcaacaactgaataacgattgacgcagtaatatatggtgacacacccattgagaaaatcgagaattgctgcatcgcgccaccgctgaccaagttcaacatgttcagaaacggtagatcagcaatttcccgcaaacggcttgcgtctacgcctggcacagtaatatgtgtacccagacgaaagacaaacaagataagtacggtgaagaaaattctcgatctaatatcttttactttaaaggcgtcctttagtagtttgaacattagatcacctcgattgatccaccagcagcaacgattgcttcttcagctgcttttgagaattttgctgctttcacagtcaatttcttcgttagttctccatttgctaatactttgattccagctttttcatctttgacgattccagcttcatgcaaagcaacaggtgttacttctgcaccgtcttcaaagcggtttaatacatcaagattgataactgcatattctttgcggttgacatttgtaaatccgcgttttggcaaacgacggaacaatggtgtttgtcccccttcaaagcctaaacgtactccgccacctgaacgagctttttgacctttttgtccgcgtccagctgttttaccgttaccagatgaagttccgcgaccaacacggttacgtacttggcgtgatccttctgatggttttaattcatgaagtttcataggtttggcacctccttaatcaaactagatctgctgatccttagacttcttcaacgtccactaagtgagaaacagtgttgaccatgcctttgattgcatcattagcaggttttactactgttgaattcaactttgtaagacctaacgcttttacagtatcgcgttggttttggggacgtccaataatactgcgttttaaagtgattttcaattcagccattatagtgtcctccttaaccgattaattcttctactgatttgccgcgaagtgctgccacttcttcagcgcgtttcaattgtttcaacccttcaactgttgcgcgaacaacgttgattggtgtgttagaacctaaagatttagatgtgatatccgctaccccagctaattccaatacggcacgaacgggtccaccagcagctaccccagaaccttctacagcaggtttcataaggatgcgtccgccgccgaatacaccgataacttcgtgagggattgtagaaccaaccattggtacttctaccaagtttttcttcgcgtcttcgattgctttacggattgcttctggtacttcttgtgctttaccagtaccgaaacctacgtgtccgtttttatcaccgacaacaactaatgcagcaaaacgtagacgacgtccacctttaacaactttagttacacggttaatcgcaacaacgcggtcttctaattccaaatgttttggatcaatataaaccatgaatggtgttcctccttctcttaaaattccagtccattttcgcgagctgcttcagctaaagctgctacacggccatggtaaaggtatccaccacggtcaaagactactactttaataccttttgctgctgcacgttctgcaactaatttgccgacagcttgtgcttgttcagttttgtttccacctgaaatttctttatctaaggcagaggcacttgctagcgtcacacccgctacgtcatcaatgatttgagcgtagatgtttttgttcgaacggaacacgtttaagcgtgggcactcagcagtaccagagattttgttacgtacacgacgatgtcttttctgacgtgttttatttttatctggttttgtaatcacaattgtcacctctttttatttgctagcctaagccgctattcgtaaatgcttacgactatttaccagttttaccttctttacgacgcacaaattcgccaacataacgaattcctttgcctttataaggttctggaggacgaacgccacgaatattggcagctaattcgccaacaacttctttatctgatcctttgatgatcacagaagtgtttgaaggaacttcaatttcgattccagctggcgcttcgatttcaaccggatgagagtaaccaacgttcaatacaagttttttaccttgcaattgagcacggtacccaaccccgatcaattctaacgctttttggaaaccttcagaaacaccaacaaccatgttgttgaagtttgcacgggtagttccgtggatagttttcatttctttactatcgtttggacgagtgaatgttacttcgtttccttcgatattcattttgatatcagaagaaaaagtacgtttcaattcacctttaggtcctttaactgtaatgtcgtttccatcttgtttgatttcaacacctgcaggaagaacgacgatcttattaccgatacgactcacttagaggcacctccttgtggattattttaaattaccatacataagcgactacttcgccgccaacattttttgctcttgcttctttgtcagtgataacaccttcagaagttgagatgatcgcgattcctaaaccgttcaatacttttggcacttcgtcagctttgacataagcacgcaaacctggtttagagatacgtttcaagtttgtgataacacgttcaccgtttttgccgtatttcaagaatacgcggatcacgccttgtttgtcatcttcgatatattcaacatcgcgaacgaaaccttcacgtttcaagatttcagcgatatcacgtttgatttttgaagcaggtacttctaagctttcgtgttttaccatattggcattacgtacacgcgttagaaaatctgcgattggatctgtcatgaccatgggataatttacctcctttatgcgagtatagtttaccagctagctttcttcacgccgggaatttgtcctttataggcaagttcgcggaagcaaatacggcaaagatgaaatttacgataaactgaatgtggacgtccgcaacgttcgcaacgagtatactcttgtgttgagaatttagcagggcgtttgtttttagcaatcattgattttttagccacgtagttcgcctcctttttttatttttggaatggcatgcctaattgtgacaacaattcacgagattcttcatctgtgttggctgttgttacaataacgatatccataccacgtactttatcgatcaaatcataatctacttcagggaagatcaattgttctttgattcctaatgtgtagtttccgcgtccgtcaaacgcttttttgctgacaccgtggaagtcacggacacgtggcaatgaaactgttactaacttgtctaagaattcatacattctttcgccgcgtagagtaactttcgcaccgattggcattccttcacgtaaacggaatccagcaatagattttttcgcttttgtgatcaatggtttttgacctgagatcaattgtaattcttcaacagctttatctaagttttttgcattcgatacagcatcaccaacacccatgttgataacgattttatcaacttttggtgcttgcataactgagctgtagttaaatttgtccattaatgatgggacaacttcttttgagtatttttctttaaggcggttcatctgttagcccctccttcctttatttgattatttatcaagaacttctccggtttttttagaaacgcggacttttttgccgtcaacttctttatagcctacacgtgttgcttcaccgttcgaaggatcaaccaccatcacgttagaaacatgaattggtgcttccatctcgacgattccgccttgaggagctgtttgagaaggtttttggtgttttttaacgacgttcacaccttcaacaacgactttgtctttcttaggaaacgctgcaagtacaacgccttctttgtttttgtctttaccagtgataactttaactttatcgccttttttaacaaacatgtttgtttcgcacctcctttagataagaatcactattacaatacttctggtgctagggaaacgatcttcataaagttgccttcacgcaattcgcgagcaactggtccaaagatacgagttccacgtgggctcttatcgtcacggataataaccgcagcattttcatcaaatttaatgtaagaaccgtctgtacgacgtgctcctgattttgtacgaacgataacggctttaacgacgtcaccttttttgacaaccccacctggcgttgcttgtttgaccgtagcaacgatcacgtcaccaatattcgcagttttacgaccagatccgccaaggactttgatcgttagaatttcacgggcacctgagttgtccgccactcttaatcggctttctgcttggatcacgatgtgtatcctcctttcagattttgcaattcacaatctatataggaaaatctcgtgtgattagataatcactgccttttcaacaatctctactagacggaaacgtttcgtagctgataatggacgagtttccataattttcacgatatcgccaacttttgcttcgttgttttcatcgtgtgctttgtatttcttagaatagttcagacgtttgccgtagatagggtggtttttcttagtttcaacgacaacagtgattgttttatccatcttgtcggataccacgcgaccttggtaaactttgcgttgatttctttcttcagtcatacgctaaatggcctccttccactattactttgcttgttcacgcaatactgttttgatgcgtgcaatcgatttacgtacttctttgatacgtgcagtgttttctaattgtcctgtagctaattggaatctaagattaaacaattcttctttcaattgtttttcttgatctagcatttcggcagtggttaattctctgatttctttaaccttcattcgattcaccacccatttcctcacgttttacgatctttgttttcactggcaatttgtgagaagcaagacgtaacgcttcacgcgcaacttcttcgggaacgccggcaatttcaaacatgattttaccacgttttactggtgatacccatccttcaggagcccctttaccagaacccatacgtaccccaattgctttggccgtataagatttgtgagggaaaattttgatccatactttcccgccacgtttcatataacgagtcattgcaatacgggcagcttcgatttggcggtttgtgatccagtgtgattcaacagcttgcaagccgtattcaccgaaaactacttcttttccgcctttcgcttcaccgcgcattttcccgcggaattcacgacggtgttttacacgtttaggtactaacatgtttatttccctcctttctcagtgttctttttagttggaagaatttctccacgataaatccacactttaactcctagttttccgtatgttgtatctgcttcttcccatgcgtaatcaatatccgcacgtaatgtatgaagtggaactgttccttctgaatagccttctgaacgagcgatatctgctccgtttagacgaccagatacttgtgttttgattcctttagcgccagaacgcattgtgcgttggatcgcttgtttttgcgcacgacggaaagcaacacggttttctaattgacgtgcgattccttcgcctactaatttagcatctaaatctggttttttgatttcaacgatgttgatgtgaactcgtttgccagttaatttgtttaattcttttcttaggttttcgacttcagatccgcctttaccgataaccatacctggtttagctgtgtggattgaaatatttacgcggtttgctgcgcgctcgatttcaattgttgacacagcggcatcagcaagtttagatgcgataaatttacggattttcaaatcttcatgtagaaattcagcatactctttttcagcataccattttgcatcccagtcacggatgatgcctacacgcattccaattggatgtactttttgacccactgattgtccctccttatttttctgatacgactacagtaatatgacttgtacgtttgttgattggagaagctgaacctttcgcacgtggacggaaacgtttcattgttggtccttcgttgacgaatgcttcagaaacaatcaagttttcaacatctaagtcaaaattgttttctgcattagcgatagctgacatcaagactttctcgatgattccagccgctttgtttggtgtgaacttcaagatcgcgattgcttcagcaacgcttttccctctgatcaaatcaataactagacgtgatttacgaggagaaacgcggactgttttagcagttgctttcgctgatgtgatttgttctgccatttttggatatcctcccctcaaaattagcgtcttgttttcttatcgtcggcagcgtgtccgcgataagttcttgttggtgcaaattcacctagtttgtgtcctaccatgtcttcttggatgtaaactggtacatgtttccgtccatcatacacagcaattgtaaatccgataaaacttgggaagattgtggaacgacgtgaccaagttttgatcacttttttcttttcagcgccttgttgtgcttcgaccttcttcatcaaatggtcatcgacaaaaggtccttttttcaaactacgacccatggtgtacctcctctcaaaatgtgcgacacatggtcaagtaaattatttagtcttgcgacgacgaacgataagtttgtctgatttagctttcttgttacgtgttttgtaaccaagtgctggttgtccccaaggtgaaactggagctttacgtccgattggagctttaccttcaccaccaccgtgtgggtgatcattagggttcattacgctaccacgtacagttgggcgtttgcgcatccaacgagaacgtccggctttaccgatgttgatcaattcatgttgttcgttaccaacagagccaattgttgcacggcatgttgccaagatcatacgtacttcgcctgagttcaagcggatcaatacatattttccttctttaccaagtacttgtgcacttgtaccagctgaacggatcaattgtccgccttttcctggtttcatttcgatgttgtggataacagtaccaactggaatattttctagtggtaatgcgttccctactttaatatctgcatctggtccagaaacgacagtcatgccaacttctaatcctttaggtgctaagatatatgcttttactccatcctcgtaatgtactaacgcaatgttagcagaacggtttggatcatattcaatcgttttaacagtagcaacgacattgtctttgttacgtttgaaatcgatcaaacggtattgacgtttgtgaccgccaccttgatgacgaaccgtgatacgtccgttgttgttacgaccagcattgtttttcaatggcgctaacaatgttttttctggtgttgaagttgtgatttcagcgaaatcagaacttgtcatattacgacggccgtttgtggtaggtttgtactttttaatcgccacgtctttttccctcccatttagtatttaaatatggtctgcttattcagcagcgtcaaaaatttggatttcttttgaatcttcagttaaagtcacaacagctttgcgacgtttttttgtgtatcctgcatatttacccatgcgtttgaatttagggcgtacgttgatgatattcacgttagccactttcactccgtcaaaggcagtttctacagcttgttttactaaagttttgttcgcttttgtgtctacttcgaaagtatatttcttgtcatccatggcaagcatagatttctcagtgatcactgggcgtttgatgacgtctagtaagttcattatgcaagcacctcctcgatctgagtaagagcagtttgtgttaccaacattttatctgctgaaacaacatccaatacgctcacgttatcagcagttactactgaaacagatggcaagttgcgtgcagataatgcagcaaagtcgttttctgtttctaaaactaccaatacttttgagtcaatagtcaagttagctaaaacttgtttgaattcttttgtttttggtgcatcaaagcttaacccttctactgctaccaagttatttgaagcaactttttctgacaatacagatttcattgctaagcgacgaacttttttaggaagtttgtagctgtatgaacgtggtgttggtccgaagactacgccacctccacgccattgtggtgaacggattgaaccttgacgagcacgaccagttcctttttggcgccatggtttacggccaccgccacgaacggcactgcgatttttcacagcgtgtgttccttgtcttaatgaagcacgttgcatgatgattgcatcgtagacaactgtttcatttggttcaattccgaagatttcttcgttcaatgtaatttcgccattttggcttccatcttgtttgaataatgctacattcggcattccttagttcctcctttcttcctatctacttatttagctttcacagctgatttgattgtaatcaatgattttttcgcgccaggtacattacctttaatcaagataacgttacgttctgcgtctacacgcacgatttccaagttttggatcgtgatgcggttaccgcccatacgtccagcaagacgtttgtttttgaatacacggttaggtgcaactggacccattgatccaggacgacggtgataacgagaaccgtgagccattggtccgcggctttgtccgtgacgtttgataacgccttggaatcctttacctttcgaagtgccggttacatcaatgatgtctcctgcttcaaaaatatcaactttaatttctgaacctacttctaagccctctagctctacattcttgaattcgcgaatgaagcgcttaggagccgtgtttgcttttgcaacatgacctttcgcaggtttgttagacaaaacttcacgcatatcttggtagccgacttgaattgcttcgtagccgtcattttcgattgttttcacttgtagcactacgtttggagtagcttctactacagttactggaatcaattcgccagattcagtgaagatttgagtcattcccacttttttccctaagattcctttggtcatgattacacctccatcttaattattatagtttgatttcaatatttacaccgcttggcaagtctagcttcattaaagcatcaactgtttttggtgttggattcacaatgtcgattagacgtttgtgtgtacgcatttcgaattgttcgcgtgaatctttgtatttgtgtgtcgcacggatgatcgtgtacaagctgcgttcagttggcaatggaattggaccagatacgccagctccagttctttttgcagtttctacgattttatccgctgattgatctaaaatacgatgttcatacgcttttaaacggatacgaattttttgttttgccattgttttccctccttcgcctattttgaaaagtagacatagctccacgaaaatttccgtcacgctcgtccatggcaaagcgtccgggcgtgtcgcaacctctcgtttcgtagccggcagttttttctttgctgccagtgtgacttacgcatatacgtaaacagcacctttatgattatattatggataaacgctgattgcaagctttttttaatgaaaagaaacgattcttttgcgtttttttcagaaaactttcttttctcttgaaaacaacaaaaaccttgcctaatgacttgctctaagcaaaagcttttccaacaaccatagctactaacgcaaaagcgccccttccggaataattctccagaaaaagcgcttcaaaccactaatcatctcgatttactactagttgattaatcctttagtcacacgttggattgctgcttttaacggaaaataagcaatagcgacaatcaaaatcgtggccactacattgatgactgttgccggcaatttgatgaccgctgccgaccaagctcctgaccagctgctgccaagataccaaagcataacagtatttttgatttgcgtcatagcaagtttcgccaagccagtaacagacccaataaccactaactgccatattgcttgcggacgttttttaaataagagaaacgcaccatatgcaaaagcccccacaataaaactttccaaaataaaataaggggcctctgtcgcatacccattcagcaaatcaaaaatcgcaaagcccagtcccccagcaagggagcctttcacataacctaataataaaactgctaataaaagaacggcattccccaagtgcacaaaggcgccggtgggcaatgggatcttgatcatcgtaccaatgactgtcaacgctgtaaacaatgccacaaagacaatacttcgaattctgtgatcattcatgtggtatcatcctttcttccgcatgattataagcaccgtgccagacgtgaccgacataaggattgatcagaaccccttgtcgaatcgccgcaacgacgaagtctttggccaagcgaatgctttctagtaacggcagcccttttgctaatccagcagtaatggctgcagaaaacgtacagcctgcaccatggttgaaatcagtatcgatcctccggctttctagagtagtaaaagagtgtccatcataaactaagtcaattgcctgcgctcctggcaaccgatgacctcctttgacgacgacacacttcgcgcctaaatgataaatccttttcgcagcttctttcatagcaacaaggtcttttaagtcccccatccccgataaaattccagcttcaatcaagttaggtgtcaccacatccgccaaaggcagcaagtattcgatcaatgcatccacactctttggctgcaaaatatgtgcggtccctttacaagcaataacaggatcgatcaccacctgtttcacttgttgttgctggatcatcttggcagcctgcgcaatattggcttcattccccaacatccctgtcttaacggcatccattggttcccccgtgaaagccgaaatcaattgtttttcgaccaaagaagtgtccatagctgtcacttcgtgggtccatcccattgacggatccatggtgacgatcgaggcaatcgaagcaaaaccaaaaacaccatactcttgaaaggtctttaaatcagcttcaattcctgcgccgcctgttgaatcggacccggcgatcgttaatactttcttcattattatcgactccttttattcagtataaccaatggtccccttgacgaaaacagccaattggcttatttttataccatccaataaaaaaaggagggctctaatgaccgataggcaaatcgataaacagaagaagcaaccactctatcagcaaatcgtcacttactttatcgaggccatccaaaatggcgattacacacctggtgaacagttgcccgccgaacgaaaactagccactcaattcggggtcaaccgttcaacgatcgtcaaggcactggatgagcttcggagtttaggatggatcacgcgcaaacgaggcagcggcacacaagtctctgaaggtcgatggggcaaccgtcagacccctctgtcttatctccgatcgtctctatctagtccctacttacagcaagacccctttgttgaagagattcagcgattgcgcacaaaagaccaaattctcgacctttatacaggtgatctgccacaagaactgcttcctgatttccaatttcctgcctttacttgggagatgatccgcaacgaaagcctgcaaagcaccccagccggctatccaccattgcaagaagtcttgatgcggcacttgacggaagatttcggaatccccttatctggacaaaaactcgtgatcacttctggctccacgcaaggtatcacactgcttatgcaagttttgttgacttcaggtgatagtattcttacggaagatccttcctttttgttttcattgcccttatttacaacaatgaatgtccgcgttctcggaatcaaacaggacgaagaagggatgcgaccgaaagacttagaacaagcattgaaagagcagaaaatcaaatttgtttatttaaatccgacattccaaaatcccaccggtcgtaccatgagccttggccgccgcaaagaaattatcgctatttgccagaggtatcaagtaccgatcatagaagatgatatctttagtgagttagcctttacgccgcaacccgaaaaatttaaggcactagcaccagattcggtcatttatctcggatctttatcaaaactctttgggtcttctatcaaaatcggctggttattagctcctgaagcattggcggatcaatttgctcaagctaaaaaaaggatgtctatcgagacaacgatttttcctcaactgttagctaatcttgctctccgttccatggagtaccctcaacaacaacaggacttgctaaaacagatggctcaaaagcaacatgccttgattcagcgactggacgctttttctgaggattgggcattccaacagaccactgggggactatacctctggctgcaatggcaacacgccccactgaaacggagagactggacacttttcttaaaaaatgattgtctagttgccccagcctttctcttcagcaatgatacaaacggatttcgtctgaactatacacgactttcggaaaatcaactagacttgttttgtcagcaattcagaaaaatcacaacacaattaaaggagcatctgtatgaatgagacaattgatctattaaccaaccaccgcacttatcgccaattcgatagcaactatcaattatcaaaggagcagttagaagcaattttatctgctgcacgacaagcacctagctggatgaacgggcaagcttattccattctcgtgatcgatgatcgttcacttcgacaacagctggttacttggaatccaggtaatcctcatatcgctgaaagttctatctttttacttttcttggctgatttaaaccgcaccaagaaagttgctgagaaaaaacaaacaccttatctggttgatgaaggtctacaaccattgttgatcgcaacaaccgatgctagtatcgctttacagtcagctgccattgctgcggaatctcttggtctaggaacagttatttccggcagtgtccgcaaagacagcaaagcgatcgccgaattgctcgaactgccagaatacgtttaccctgtggctggattaagtattggcaaaccaattgtagatatggctctcaagcctcgcttgcctcaagaggcggtaatccattacaacaaataccaggattattcctatcaagcgatcgaagactatgaccaaatcatgaccgccttcggtgaagcgagagaaacaatgccttggtccgaaaaattcgccaatttctacggccgtgtccctgaccaaggctttgatcagtttctaaaagatcaaaaattgatcaaataaaaattttcaagcaaaaaaaagcagaagcgctagcgcttctgctttttgcatttatcaagtcaattaagctttgatttcagttacaacgcctgaaccaacagtacgtccgccttcacgaattgagaaacgagttccgtcttcgatagcgattgggtggatcaattcaacgtcgattgttacgttatcgccaggcataaccatttcagttccttctggtaattcaacaacaccagttacgtcagttgtacggaagtagaactgaggacggtagttagtgaagaatggagtgtgacgtccaccttcttcttttgtcaaaacataaacttcagctttgaattttgtatgaggtgtgattgtaccagctttagccaatacttgtccacgttggatgtcttcacgagcaaccccacgtagcaatgcaccaatgttatcccctgcttcagcatagtctaacaatttacggaacatttcaacacctgttacagttgttttagcagtttcgtcagcaataccaacgatttctacttcatcaccaacgcgaacttgtccacgttcaacacggcctgtagcaacagtaccacgtccagtgattgagaatacgtcttcgactggcatcatgaatggtttgtcagtatcacgttctggagttggaacgtattcgtcaactgcagccatcaattccatgattttttcttcgtatgaaggatctccttcaagagctttcaaagcagaaccggcgattacaggaacatcgtcgcctgggaagtcatattcagacaataggtcacgaacttccatttcaactaattctagcaattcttcgtcatcaaccatatccattttgttcaagaaaacaacgatgtatggtacgccaacgttacgtgataacaagatgtgttcacgagtttgaggcataggaccgtcagcagcagatactactaagatcgcaccgtccatttgcgcagcaccagtgatcatgtttttaacatagtccgcgtgtcctgggcagtctacgtgagcgtagtggcgagcttcagtttcatactcaacgtgagcagttgagatagtgattccgcgttcgcgttcttctggagcaccatcgatttggtcgtaagcagaagcttgtgccaaaccttttttagataatacagttgtgatagcagctgtaagtgtagttttaccatggtcaacgtgtccgatcgtaccaatgtttacgtggggtttagaacggtcaaatttttcttttgccattttaaaatgttcctcctaaaaatacagtttattttttatatttgataggtagagggcgcgaagccccccatcccttatcatcgataatattgtacacgaaacttcataaaaaatatagctttttactgaatttcgcatttgtgcatcaattattcagctttgccgccgtttttcttgatgatttcttcttgaacagacttaggtacatcttcatagtgatcaaatgtcatcatgaaagtaccgcgtccttgagtagatgaacgaagtgttgttgcatatccgaacatttcagccaatggaacaatcgcgttaacgatttgtgagttaccatgcgcttccataccttcaacacgtccacgacgagcagttacgtgtcccataacatcacctaagtaatcttcaggaacagtgataacaactttcatcattggttcaagaatcactggattagctttcttcgctgcagcacgtaaagccattgaagctgccacacggaaggctgtttcacttgaatcgacatcatggtatgaaccatcgtaaagcttggctttgatgtcaaccaatggataaccagctagaacaccgttagccattgagtcttcaagtcctttttcaactgctgggatgtattcacgtggaaccacaccaccgacaattgcgttttcgaattcgaagcctttaccttcttcgtttggtgtaaattcgatccatacgtgaccgtattgacctttaccaccagactgacgtacaaatttaccttcggcttgcgtagaagcacggaatgtttcgcggtaagaaacttgaggcgcaccaacgtttgcttcaactttaaattcgcgacgcatacggtcaacaaggacgtccaagtgaagttcacccatccctgcgataacagtttcgccagtttcagcgtttgtttctacacggaatgaaggatcttcttcagcaagtttttgtaaagccacacccattttatcttggtcagcttttgatttaggttcaacagctacttcgataactggttctgggaattcgattgattcaaggataactggtgatttttcgtcacacaatgtatcccctgttgttgtatctttcaaaccaacagctgcagcgatatcgcctgaataaactgtttggatttctgcacgagtgttcgcgtgcatttgcaggatacgaccgatacgttcgcgtttgtcttttgaagcattcaagacatatgatccagagttcaagacacctgaatacacacggaagaatgtcaaacgacctacgaatgggtcagtcattactttaaatgctagtgaagcaaaaggcgcttcatcgtcagcaggacgatcagtttcttcgtcagttttaggattgatccctttgattgcaggaacatcaagtggtgaaggaaggtagtcgatgactgcatccaacatcaattgaacccctttgtttttgaaggctgaaccacaaagaactgggaaaaattcaacagtcaatgtcgcttgacggataccagctttcaattcttcttcagtgatttcttcaccttccaagaatttcatcattagctcttcgtcagtatctgcaacagcttcaactaatttttcgcgccattcttcagctaattctttgtactcttcaggaatttcagtttcttgaatctctgttcctaaatcgtttgtatagatctcagctttcatttttactagatcgatgataccagtaaagtcatcttccgcaccaattggtaattggattggatgagcatttgcttgcaagcgatcatgtaaagtagatacagagtataagaagtctgcaccgattttatccattttgttacagaatacgatacgtggtacgcggtaatctgtcgcttgacgccaaactgtttcagtttgtggttctacaccagattgtgagtccaatactgttacagcaccgtcaagaacccgtagtgaacgttgtacttcaattgtgaagtccacgtgtccaggagtgtcgatgatatttacgcggttttctttccattgcgcagttgtcgcagcagaagtgatcgtgatcccacgttcttgttcttgttccatccagtccatttgagaagcaccttcatgtgtttccccaattttatggattttacctgtgtaataaaggatacgttcagttgtcgttgttttaccagcgtcaacgtgggccatgatcccgatattacgagttttttctagcgaaaattctcttgccattctaggttgttcccctctcattcttacttaaacctaagctaaggttgtctcagtaccttccaataaaaagcagtgaggatcttaccaacgatagtgagcaaatgcgcggttggcttccgccattttgtgtgtgtcttcgcgtttcttcacagaagcaccagtgttgtttgctgcatccatgatttctttcgcaagacgttcttccattgtgtgttcgccacgcaaacgagcgtagtttaccacccaacgaagacctagagttgtacgacgttctggacgaacttcaactgggacttggtagttagaaccaccgacacggcgagctttaacttccaatacaggcataatgttcttcattgcttgttcgaaaacttccaatggatcatttcctgtagattctttgataatgccaaaagcattgtagataatatttgcagcaacaccgcgtttaccatcaaccattacacggttgatcaaacgagttactaattttgagttataaataggatctggtaaaacatcacgttttgcaacaggacctttacgaggcatccgtaactcctccttccgaaatatcagttctgattaaatagtttcatttgtagtttgaatcaaaattaagctttaggacgttttgttccatatttagaacgagattgtttacgatcgttaacaccggcagtatccaatgcaccacgaacgatatggtaacgtacccctggtaagtcttttacacgtccaccgcgtagcaataccacactgtgttcttgcaagttgtgaccgatacctggaatataagctgtcacttcaatcaagtttgacaaacgaacacgcgcatatttacgtagagctgagttcggttttttcggtgtcatagttcccacacgagtagctaccccacgcttttgaggtgagttaacattcgtttgagcttttttgaaactgttgtatcctttgttcaatgctggtgaatttgatttttcaaccttggatttacgaggtttacgtactaattgattaattgtaggcatccctagttttcctccttccttgattcgctttatagttccacacatccaggtggttctttttttgcgataaaaaataatgcattctctgcattcttatcaaatatgctttgataaacagtcagcacgtctccaacgagagacctgtagataaagcacctttgatagaataccatgataaaaagactctgtcaaccatctctccaatgattttttatgaaaggagtaactgccaaaattttataaaaaaactctcccttgcgcctcctttttacttcttcttactatataataaagatgaaaatagtattttattagaggtgggtcaataatgaatctaaaagagatggtcggtattgaagcggccagctatgtcactgacggtatggtcgtcggtttaggaactggttcaactgcgtattacatgatcgaagaattggggcgcagagtgaaagaagaaaacttgtcgatcgttggtgtaccaacatcctgggcatcaaaaaaacaagcagaatcgttagggatcccggtcaaaacgatcgatgaagtggcaagtgtcgatttaacgatcgatggtgcagatgagatcagcggagactatcatggaatcaaaggtggcggtgccgcactgctttttgaaaaaatcgtcgcaacctactctaaaaaagttctttggattgttgataaatcaaagatcgttgaaaaattaggcgcattcccattacctgtagaagtgattccctatggcagtcagcaattgatgcgattgtttacagaaaaaaactatcaccctgtccttcgcctagccgaagatggcaccccgctaaaaactgattgcggtcattacatcattgatcttcatctacaaaccatcaatgaaccagttgcattggctcatgaactagatcaaaccgtcggtgttgtagagcacgggctcttcttggatatggtccatacgatcatcattggacaagaagatggacctgagacccgcagcgttcgctgatgcctctagcaacaaaaggagcaagtgctccttttgttcgaggttctacgtatttttcttcatttttctagagttaaattcatttttgtgcaagttttctctatcatttatgcctcatttatgctacattcaaataaaaaagaataggaaggagcggctatgaaagtcatcggttatgctcgcacaacaattattgataaagaatcaagtgaacaattaaacaaactaaaagaatttggttgtacagaattgttccacgaaacctatgcctacgaagaaaactgtgataaccactcattagaatctgtgattgctcgtatgcagtctggggaaacgctggttgtttctgaacttcatcgtttaggtaaaacaacccggcaattaactgaattgacagatcttctaagaaaaagaaaccttcacctagtttctctagcagaaaacatcgatacgagagaacccatgggggcgatttatttcaatttaatggaaggtttggcagcgatggaacaagccttaatcaaagaacggacattagtcggattgaacaatgcccgaaagaacggcaaaattggcggacgtccaaaaatcgatccaaaaaccatcaaaaaaattcgccagctttattacaataaaaaagagacgattcaattcatctccacaaaatgcggtgtttctgtcggaacctgctataaatacataaaactttcagaagaagaattggataaagtatacagtcattaatcacttgtctgaatccggtgcttcatctttttttctgtgcgccgatcctgtcagacaaaatgattcagaaataaaaaagaacgtcttgaagaaagacgtttttttctgtttctttttttaagaaacaaggttttacgctaaatacgtagaaattctttgcgaaaaagtgtacaataaacagggaattgaaaatttcagaaaaatatctaatatctaaaaggagagttttacatgccaaaattagtattttctcgtcacggactaagcgaatggaataaattgaaccaatttactggttgggccgatgtagatttagcgccagaaggtgtcgaagaagcaatcgagggcggacgtaaaatcaaagaagccggcatcgaattcgatgttgcctacacatctgtattaactcgtgccatcaaaacttgtaactacattttagaatattctgatcaactatgggtgccaacaatcaaatcttggcgtttgaacgaacgtcactacggtaaactacaaggattgaacaaaaaagaaactgctgaaaaatacggagacgaacaagttcacatctggcgtcgttcctacgatgtattgcctccattgatggatgcatctgatgaaggttctgcagcaaacgatcgtcgttatgcaatgcttgatcctcgcgacgtacctggcggcgaaaacttgaaagtaacgctagaacgtgcattacctttctggcaagatgaaatcgcacctgcattgaaagacaacaaaactgttttagttgccgctcacggaaactctctacgtgcgttagcaaaacacatcgaaggtatctctgatgaagacatcatggatcttgaaattccaacaggtcaaccacttgtttatgaattgaacgatgatctaacagttgcgaaaaaatattacttataatcattaacagccaaggctgtgctgcaagtcagagcaagagtattcttcctgactgacggcacagtctttttttgattggtttcctgagaaatattcgttataattgaaaccgcatacgaaaggagcttggaatgatgaccacactctgtaaaaatgatacgctactatttcttggagatagcatcaccgactgcggccgtgatcgactcgatgctacggatctgggaaaaggattttccgcctttgtggcagcccatctagctgcagaatacccagatgcaaacttgtcatttgttaaccgcggcattagcgggaataaaattcgcgatatcttaaatcgcatcgaggaagactgcattgatttaaagccagatctactgattttcttgatcggtatcaatgatacctggcgcaatattggcacctcctctttcggcacacccgaagcaactgcgacatttgctagtgattatcggcaatttttgcagcaagtgaccgaaagtgggatcaagaaaatcctgcttttagagccatttgttcttccttatccagcagatcgcaaacaatggcggaaggatttggatcccaagatccattccattcgtgaactagctgctgaatttggttgtgactaccttcctttagacggcttattcgctgaacgtactgtcaaaaaacattcatcttattatactggggaagatggtgtacatccaacaatcgccggacatggtgtgatcgcacaagagatcttgcgccgtatccattattcaagataattctttgatagaagtacgcagacaaataatcggtaggataccaattaccctaccgattatttgtctattctgtcaggatttcttcatttagagatactctgaaggggtcaaagcctcttgataaatggcaatgacatcagattctgtcaacggtacgtaggcatttgtcgcaattgaactaaatgctactgcttgtttggccatttcttcaaaatgacgatcatcttcgatccccacttctggtaaagtcattgggatcccacaagcaaggaagaaatcgtataacttttgaatccccatccgagctgccatttctgggaccgcttcttctacttggaatacttcacgggcaaagcgagccaacttaggtgctgttgtctcattcaacacatgaagcatccagcggggcgtcaagatggctaagccgatcccatgagtaatatcataaaaagcactcaactcatgttccattggatggcacgaccacgcaccggctttcccactacctgtcaacccatttaacgccaatgtacttgcccacatcaagtttgcccgagcatcatagtcatctggggtatccaaaacaatcggcaagtttgtgattaccgctttcaacagcccttctgcgatgccgtcttgtacatccgtattctctgttgtactaaagtagttttcgatcagatgactcataatatctgcagaaccagccgctgtttgatagcgattgacgctaaaggtccaggtgggatctaagaaagaaaccttcggcaagaaattaggaccgtggacccctaatttttgtttcgctgtaaggttcgtgataactgctccccgattcatttcactaccagttgcagctaatgtcaaaaccgtaactaatggcaatgctggcccttggtagctgcgtttagtcactaaagtccaaggatcttcctcactgcaagcagcacctgcgatcactttgctgcaatcaatcacggagccgcctccgactgcaagaatcacatcaattttttcagtgcggcagagttctgccccttttgctactgtttcaatccgagggtttggttcaactcctgctaattctgttacttgattgtcattgttttgcaattgcgccatgacttgatcataaagtccgctttttttgatactgccgccgccatagaccaataggacattttttccgaaagtattcaatacttccggcaactcatttaaccgatctttcccaaaacgtatatccgttgtcacctgaaaagtaaaattattcatgctccaacctccttttctttaattaaaccattttcgtccaaaagtgcaactattccaactagctagaaagattcaatcaatcatttaacaaaaaatcactttctgactggctcccattgtctaaggagtcaatcagaaagcgatacaggaataaaaaattttttgtaggctgtaggataagaaaaaggattaggagatagctgtttctaagccaactttgatcatatcattgaatgttgtttgtctctcttccgctgttgtttcttctccagtgatgatatgatcactgactgtgcagatcgctaaggtctgtacgtggaattttgctcctaaatagtaaagcgcagcggcctccatctcaacacctaatacaccaagatcagccaattccactgtttctgccatatcatctttatagaaagtatcttccgataaaatgttcccaacgtgggtggtaaagccggatgcaatcgctgtatcatacgctttacgcaacaagtcgaaatctgcgattggcggaaaatgaaaactttgaaagttctttgctaccatggaagaacttgtcgctgcagcttgggcgatcactaagtcccgaacatgaacatctttagaaatcgcgccacaagtgccgacacgaatcaatttttttacgccataagaattgatcaattcatgggcataaatggtcgcagaaggcatccccataccagttccttgtactgatactcgctcacctttgtagacaccggtataaccgagcatccctcggacattgttataacagatcgggtcttctaaaaatgtttctgcaatgtattttgcgcgtagaggatcgccaggtaataaaatcttatcagcaatctcgccagcttttgcttcaatatgaacgctcatcttttcgctccttttctacttctcttttatgctctttttttagggtttgcttgttttacagattcgctaaagtttctttgatcagcgctttaaattcggctttgacccgttctgttgtctctacgacttcttcatggttcaggcttgcttgcataccagcagctagattggtgatacatgaaacgcccaacactttcaagccactatgaacagctacgattacctcaggaaccgtcgacatacccacagcatctgcaccgatcgtacgagcaaatcgaatttcagcaggtgtttcataagtcggcccagaaaagcccatgtaaactccttcttttaagtggagaccttttgtttctgcaatttgttttgctgtttcccggtagcttggatgataagcctggctcatatcagggaatcgtggtcccatttcttcttcgttagccccaatcaatggattgtcccccatgaaattgatttgatccgtgatcaacatcaaatcaccaggttggaaactttcattcactccgccgcatgcgttcgtcacaacaagtgaatgtgcttcaagggccgccattactcgaacagggtaagtaactgtctgcatggaatgtccttcatagtaatggaaacgaccttgcatcgccaatactttttttccagataatgtaccataaactagttgtccggcatgcccgacgactgttgaaactggaaaatgagggatatcgttataaggcagcacaattggattttcaatctcatctgctaattcacctaatcctgaacctaagatcaaaccaaaatcaatagatcctacccctttttccttgatgaatgtcgttgtttcctgcaatttctcatgtaatgttgtcatttctccacctctaatttaaatgatttaagaagctttccccattttctgttgccggtactgcaaagttttctgcaattgttgctgaaatatcggcataatggccttggggtagttggccttgtcctttaaattgtttgctgtaaaccaataatggtacatattctcttgtatgatcagtcccagtaaaggttggatcatttccgtgatcggctgtgatcattaataaatcatcgtcagccatggcatccagaatctctgggattcttaaatcgaaatcttcaatggcatgagcataaccgacaacatcccggcgatggccgtaaagcgcatcgaaatcaactaaattagtaaaacttaggccggtaaagtcttgcttcatcacattcaatagctgatccacaccatccatattgctctttgttcttactgaatcagtgattccttgaccattgaagatgtcattgatctttccgacagcgatgacgtctttgccagcatctttcaacgaatccaacactgtgtgtccaaaaggatccagtgcatagtcatgccggttgcttgtccgggtgaagtttcctggttcaccaacataagggcgagcaatgatgcggccgatcatatatggttcatctttggtaatatcacgcacatattggcaaatgcggtacaattcttccaacggaatgatttcttcatgagctgcaatttgcaagactggatcggcagacgtataaacgatcaaatcgcctgttttcatttggtgttcaccgtaatcatcaatgactgctgtaccggaataaggtttgttgcagacgattttacgtccagaaaattcttcgatttgttgcagcaattcttgaggaaatccgtcaggaaacacacgaaacggtttttgaatattcaaacccatgatttcccagtgtccagtcatggtatcttttccgacagagatttcttctagtttcgttgcatagccgtcatggtctgctacatttttgacaccatccagcggtcggatcgtaccaagacctaactgttccaaatgaggaatcgtcaatccagcttctttggcgatatgtcctaatgtatcagaaccaacgtcaccaaatttttctgcatcgggcgcttcaccgatacctacagaatccattacgatcaaatgtacacgtttaaacattcttttccctactttcttttattgttattcttttcttatcatactagaaataagaaagatttgcctttaaggatgtttgagatattgggtttcttgctgctacacaaaaaaaagggcagggcacagcaacacaaacatgtcccatagccccaccctttcatacagaaaaaattatttagatttgatgtagttcttaccgttagctttaggtcctgccgctttcccaaggaacagcactagaacaataattgttaacgcatatggtgctgcttgtagataaaccgctggaatggaggaaatgattggcaattgtccgccaacgatactgatgttttgcgcaaagccgaagaaaattgcagcgcccatcgcacctaacggattccatttaccaaagatcattgctgccattgagataaacccttgaccggcaatcgttgttacagcaaaacgtccagcgattgattgggcaaataacgcgccacccattccgcctaggaaaccggagatcaacacgccagaatagcgcatcacatagacattgattcctaaggtatctgctgcctgagggtgttcacccacggaacgtagccgtaagccaaatcgtgttttaaagatgacaaaccaagcaatcacagaaatcaagatcgcaaagtaagcaggtaaaaacgtttggttaaagaagactggaccaatcacaggaatatcacgcaacacaggaaaattgaaataccctaatgtttgttgaatattgtctgtttgccctttgttgtagatggctttaactaagaagacagccagcgctggcgccatcaaattcattacggtaccactgataatgtgatctgctctaaagttgatggtggctacagcatgcagcagtgagaaggccattcctactaacccgccgactagcattcctaaccaaggtgtccatgcaccaaattgtgacgcaaattcaatattgaaaacgatcgaactgaaggcacccatcaccatgattccttcaagacctacgttaacgatcccgcttcgctctgagaaaacgccgcccagtgcagtcaggatcaatggtgcagcataaatcaacgtttgtgtgacgatcgaagaaattaaactgatattcattagatggttcctccttcctgatcttgattatttggctttgcttcaatttcttggacaacagcgacttcctttttgccatcaaagattttagctaatacaaaacgaatcacgtagctgatcgcaacgaagaagatgatgatcgcaatgtcgacatcaacaagttctgaaggaatccctgcaaactgcattccttgtccgcccagtttaagaacactgaacagcaatgcagaaagtaaaatcccaatcgaagacccgctgcctaataatgagactgccatcccatcaaaaccaatactcaatgacgaaccttgaacgaagaagttttcaaaagttcccaaaccttgaacgacgccacctaatccagctaatgttccagagatgatcattgaaataatgattgtccgtttgctgctcatcccagcatactcagatgcggttggattcaaaccaactgctcgaatctcataacctaacgttgttttcttcatcatgaaccaaatcaacacgaggaagatcagtgccatgaaaataccaatgtttaaccgggaattgttggtcaaatttgctaagaaaggtgtttgtaaagaggcattgtcgcctaccattttggtcacaccttttgttgtgatcatggattcattcatgacgttattgacgatatgatttcctgtatacaataaaatataattcatcataatagttacgataacttcactcgtaccaaagaaggcacgtaagatacctggaatagctgcagcaattgcaccacaggctgcccctacaagaatagcggtaggcaacacgatgattcgaggagcatctggcatagacaatgcgacccagatacttgctacccatcctgctaatgcttgtccagaaagaccgatattaaagaatcctgcagaattcgctactgcgaatcccaaagctgtaaaaatcagtggaccagctgtaacgaaaatctcaccaatatttctagcattcaatccgccgttttgaccattgataaatacggtacggaacatttgaagatacccatcgattgggctgtagccaaatgccgccatgatgattccaccaaggataaaaccaagcagaacagcaatgatcggcacaagcaggttccgaattttttctttgcggttattcaacagaaccacctacttcctccatttgtagctcgcgtcgggcttcttctaatgaataacccgccattagtaatccgagttctttttctgatgtctctttcggatcaacgacgccaacaatctcaccagcatggataacggcgattcggtctgatacgttcaaaatctcatctaattcgaagctgactaacaagacagctttgaatttgtcccgctgttcgatcaaacgtttatggataaactcaattgcgcctacgtctaagccccgtgttgggttcgctacgatcaaaagatccggatcacggctgatttcccgtgcaataatcgccttttgctgattcccgccagagagggcacgagcaggaacaatctcattgactgtacggacatcaaactcttggatcaatccacgggcaaattcattcatttccccgtagtccagcacgccataattgctcagcggtttttgataatacgtttgtaaagcaatgttttctgaaagcatcatgtctagaaccaatccatatttatgacggtcttccggcacatgcccgacacctgcctccgttactttacgaggtttgaaatttgtaatgtcgtcaccattcaataagactttgccgctttcggattttcttaatcctgtgattgcctgtagcaattccgactgtccgttgccatcgattccggcaatccccagaacttccccagcccgcacttccaaacttaagcctttaacagcctctaggccgcgattttcttttacaactaagttttcgatagacaggacgacttcttttggttctgcaggttttttcggtgttttgaaggaaacagaacgaccaaccatcatatctgccaattgctgtgacgttacgtctttgacattgactgtacctattcctttgcctcggcgaatcactgtacaacggtccgctactgctttgatttcatccaacttatgagtaatcaaaatgatggattttccttcccgaacaagtcctctcataatgacaatcaattcttcgatttcttgtggtgtcagtactgcagttggttcatcaaaaatcagtacatctgcaccccggtataatgtttttagaatctccacacgctgttccatcccgactgagatgtctcgcacataagcatctgggtcaaccgataagccatattgctcagaaacccgtttgatttctttgcgggcttttttacggtccaacacacccaatttatttggttcgcttcctaaaatgatattttccgtgacagtaaacgcgtcaaccagcataaaatgctgatggaccataccaatgccaagtttattagctgctgtagggctagtaatattcactttctccccattcatcaagatatcgcctgatgtcggttctaacaaacctgacagcatattcatcaaggtcgacttgccagctccgttttccccaagcaatgcgtggatttctcccggccttacttgtaagttgacatcgtcattggctttgaaggttccaaactctttggtgatatggcgcatttctacaacatatttttcttcagccaagtttctcacatccttactttctaattcgctctcacactcagtgacacaacaatttttaatacaaataaatgctattgcttaggatggttattatcctcatgaaaactcaacagctttcatcaagacattaaccactaaagatgtattagcaagacgagcatctgaacgatagtgaatcgctcaactctactatcgttcagaatttcttgtctttttttttcattgtttaaaaaaacttgcttatttttctggtttttctggcacttcaactttgccatcgatcacatcttgttttgctgtttcgatcgctgcttttgcatcatctgataagaaaccttcagtgatatctacaccgccgtctttcaaaccataaacgatgtgttcgccgccagggaagttatcttctaatgcacgtgttgaaatatcttgtacggctgcgcctacacctttaagtgttgaagccaatgtgaagttgtcttctttgccgtcttttgttttgtatgcaccttcgtcttgttggtcgctatctacaccgataacccaaacttttttgtctgcaaggtcagcttcgttcaattgttcattgattgcttttgcttcttggaagacaccagcaccagtaccacctgaagcatggaagattacgtcaacgccgccttggtacattgaagctgctagggctttcccttttgcagggtcaccaaatgatgctgcatattgagaatcaattttaatctctttgcctaatgctttagaagcatcttcgacacctttgataaaaccagcttcaaaacggtcgattacgacaccttcttcaccgccgataaagccaactttgtttgtttttgttgtataagctgctgcaaaaccagctaagtaagctgcttcgttgtctttgaaggttgcagaaacaacattgtctttgccttcgatgacatcatcgataatcccaaattgagtatcagggttttgtgctgcagctgcttcaattgaatctttcaataggtaaccgacaccaaaaatcgttttgaatccgttttggacagcaccatttacgtttgttgtatattctgaagcttcatttgattgaacgtagtcatatccaccaacaccgcgagcgatgttatgttctttcccccaagcttccaaaccttcccaagcagattggttgaatgaacggtcatctacaccaccgatatcggtaacgattgctacactgtgtgctgcatctgttttgccgtctgcagaaccgccgcctgttgaatcagtcgaacctgactttcctccattgccacatgcaccaagtagtgtcaacccagccactgcaacaattcctaaactaaataattttgcttttttcattgctgtaaagccccctataaaatagtttttatttttcaacagccgcttcgactgaatgaacatggtttatagatctttgttcgtaaaataatatggcagcaacccttcgacagttgtctctttgattataccatcgtctcccacaagagtgactggcatatccggctgacagaactcaaccattacttggcggcaggcgccacaaggtgagataggctctggcgtatgaccagcaacaactaagtgttgaaagtctttttcgccttctgaaattgctttgaaaaatgcggtgcgttccgcgcaattcgttaagccaaacgaagcattttcgatattgatgccttgatagatggttccttttttggtgaccaagcaggccccaactggaaatttagaataaggaacgtaagctttgtctaatgcggcaactgccgtttcgatccactcttttttcgcttttgtcatgatgaacctcactttattgaattagtagccagcccccgttgaccctgtaacgattgctacacttgcactggttcctaaacgatttgctcctgcttcgaccattgctgctgcttctgcttcgttatggatgccgccagatgctttcacacccatttcagggcccactgtttcacgcatcagtttgacatcagcaacaaccgctccgccagtagagaatcctgtcgatgttttgacaaaatcagctcctgctgctttcgctaattcacaggcctttacgatttcttcattgtctaaaagtgctgtttcaataatgactttcactaatgctttgtctttagctgctgcaacaaccgcttcgatatccgcttgaacttttttgaactgttttgatttcaaggcaccaatattaatgaccatatccacttcatcggcaccattcttgatggcatctgccgtttcataagctttgacttctgatgtattggcacctaaaggaaagccgatcacggtacaaacagccgtcggttcaccttttaattcttctgctgccaaagctacccaagtaggattgatacagacagaataaaagtgataggtttttgcctcttcaatgatgcgcaagacatcttcttttgttgcatctgcctttaaaatagtgtggtcgatcatgcgatttaattccattccactcgctccttattctgtaatgatttcatggatcaacggtggctcaccgccgctttctccgatttcaatattttgatagatcaattcgatgacatcatcgatggcttctgtgttgctgtagatcgttaacagtgcttcaccttgctcaacagactctcccacttttttatgcagtttgattcctactgcgtgatcgatgtcttcttctttggttttgcggccggcacctaacatcatagctgcgatgcctagttcattggcaacgatcttagttacgacgccagaagtttttgctggtaatgctctttgataattggcagtcaagatttggcttggatcatcgatcactgaatcatcgccaccttgattacggatcatttcacgaaatttagccaacgctttaccagagtgcagtgcctcttccaataatgcgcgtgcttcttccaacgattctgctttttgggctaaaacaaccatttggctgcctaatgcatagcacatttcttctaaatcagctggaccgtttccttgcaatgtttcaatagcttccactacttccaaactatttccaatggcttcgcctaatggctgtgacatatctgagatcacagccattgtctgacggttcgctaatttgccaatccgaaccatcgtttgtgctaagcgtttggcatcctcaattttcttcatgaaagcaccgtcaccagtcgtcacatctaacacgatggcatccgcacctgctgcgattttcttactcatgatcgagctagcgatcaatggaatcgagcttacggtcgctgtgacatcccgcaacgcatataattttttgtctgcagggtccaaatcccccgactgaccgataaccgccactttgctttcgtttacgaggcgaataaactcttcttctgcaatctcaatctgaaacccgggaattgattctaatttatccagcgtaccgcctgtgtaaccaagtccacgaccagacatcttggcaactggcacaccaacacttgctactagtggtgctagaatcaacgtggtagtatcaccgacaccccctgttgaatgtttatctactttgatgccttcgattgaagaaagatcaatgacttcaccagaatttgccatagctaaagttaggtttgtgatttcttcatcggacatatccacataaaaaatagccatcaacaaagcactcatctgataatctggaatacttccttcagtatacgcagttacaatgtagtcgatctcttcctttgtcaatgacttaccgtcacgctttttttcaattaaatccaccattcgcatcaaaatgaccctcgcttcctctgacattatacaatatttttcttgtaggtaaaccactttagtaaaacggtttactatataaaacaaaactatgaaaacacttacaattggaaatataccgcactatttcgcaattgtcaatgccttcacgctctcacgaagaattaattttgtatcaaaaatcttatttggaattcttcgagaaggaaactcgatggcgtctaccaaaaatttcgctgccgtaaagccaatctcaaaggttggctgcatcaccgtggtcaatggtggtgtgatgtattccgttagcttcaatgcgtcaaaaccaatcacagaaatatcctcgggcacttttttccctgcttcatagattgcttgataacagccgatcgccatagcatcattcccacaaaaaatagccgtaagctcgcggtatttcaataatttcttgcaggcatcgtatccgccggtcactgttaactcagccgactccacgtaacgccctttaaacgggatctgatgatctttcaacgcatgacgataaccattgaaacgttcttccaattgataataaccagtactttcttttagcataccgatgttttgatggccattattgatcagatagctgactgcttgataagcgccttcgtattctttcacaatcaaacggccattgtctctttgattgattccccgatcgacgagaataattggtcggtcatcaaaaaaaccgctcttcaatgaatactcgtcaggcagctgatgcggtgttgccaaaagaataccatccactgatcgatgagacagctctctcaaatattgtatttctttttcttggctatgtcgggagttacacaataccagcatataccccaatggattgaaatagctttctgctccttcaatgattttagaaaagaaaaaatccgtaacgtcaggaacaatcataccgatcgtttttgagtggcgattgattagattcgaagcaaaaaaatctggcttataatggtgcttattaacgatatccagtacccgtttgcgggtttcttcactgaaacggctacctttattgttcagaatttgcgaaacagtagttacagatacccctgccatttcagcaatctgcttgattgtcagtttcatttacttctcacctctttcttgcctaaagtgtagcaaattttttctaaaaaaaatagcaccccttgctttcttccaaaattttctttttacaagggttaaaaaacagctccattccttaaaaaaatcgacaaaagaaaacaaaaaataaaagaccagcgattctaggcagctccttgtagtgaccccaaaaagttagagtactcggtcttgactgtacggtcataggagccgttacgagaattacccgtgttaaaaccaatgcgatggtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacagaagggacttccttttttctatttacacaaaatattttacactctcgaaaatttctctcccattttaatataaacaagcatctttaatatattttaattacttattgttatagtattatacattttgtaaattttattttaaagctttaatgttatgatagaaaaggatagcttcaatctccactagatacttcagcgcattcactatttttgctacattctattctttgatagcttgtcttattatcctcaatttatacaaataatctctcgcaatgagtactgtattcctattaaaatatcataatttaaatctagtttttcaatgaacagcattctgtttctaatttaattacatcatgcatttgaataaattggtgatttcttgtgtataacttttgtttctcatttacgcctattaatcatgtagtagattttcattaagtagatggtattgtctcaaaaaaagataaattgaggtaaataagaacattaagccagaacatattatcaatacagcaattactttcccctgatatgttactatatagtccccatttgcactaattaatgttctaagaggtaatgatgtaaacgttacagttaaaggaatcaagattaataaactgcaaaataatctaaaaaataaagatacttttgatttcgtcaatcccattgttcccccaacaaagggtactattagtataaatatgggaattccaaaggtaaaaatacttagagtaattattgttccccattcccataggaataatcctgctatcatgaataaataactgaataacatgattaaatgagtaccttttctaaattgatttaatatatgtattctcttcctttcaccttaaagtgttaatgagtgacttacctaaattttttcttaggctgcctagaattggctaggctagacagaaaaattaaggtattaaaaataataaaaaaatactcgagtattttttagtgaaaagacctcaccgaagaacctatgtaaaataattcaaacaataagtaatcaatctctcccttacaggtaaatcacataccgaaatcattcaatattacgagcttcatagcttctgattctgatagaagagataggtctcctaaggacgcttacataaaacatgggaggaattaatgaaagaaattggatttgcaaattttataatcaagttagccacctagaaaataaaaaaacatcatagtgaaaaatcgtgtattattgaggttcctacaccgatcaataaggagattttcactatgactaacacttattctacaacagaacgtgccaaaggaaaacatctaactgctattgaacgcagaaaaatcgctggttaggctgctgaaaagctgtcgaatcgagaaattgctcgaagaatcggtgttcatcatacaaccattgccaatgaacttgctcgtggtaaagtcgaacagacacgaaaaatcaatggtaccaaacatagctatttcaagtatgatccagagtatgctcaaatctgctatgaacaaaagcgaaaaaagtgtcactgcccctctaaatttcattaagtaaagtcttttctagcttactttgtccaacagtttcaaacagctaactattcacccgatgtagcagtcggtgtcgcaatctttcagccatcggagatggtgtgtacaacgactctctacaaatacatcgacgaacagcgattagaaatcagaaatattgatcttttgtataaactaagtcggaaaacacataagaaatgccctcgtacaaacaaaaaagttttaggtccaagcattgagcaacggcctgagcacattgattctcgtgaagaatttggacactttgaaatcgacacggttgttggtaaacgttccggttcagaaacggccttgcttacccttacagaacgtcaaactcatttttagattattcgtatgattgatgggaaagattctgattcggttgcctatgcgatggaacaattaatccaacaatttggggcagagagttttaaaaaggtatttaaatccatcacttcagacaatggatcagaattttctactctgaaagatacactgggaggctatactgaagttttctttactcacccctatacatcatgtgaaagaggaacgaatgagaatcataaacgcatgattcgccgtgagatacctaaaggtgaaagcttagaaatatatgggcgcaaagatattcagaaaatcgaagatggcatgaatgaactatcaagaagaattcttggttaccagtccccaaggcagtgatttgaacaagaataccagatagcgttgagttgatttgacagtgagcctcctgtcgtatggcttcacgtctgggaagtctggcatatgctagctcactatcaaatcaacaacgtagtcttaaataacacacaatattcacttttttcaataggtggctaatttgttcttgcaattttggatatcaattaaagtgttgccacagaaaaaaatatatttttactcgtgtttacaaaaacaaaaatattgcccaaatttcaagtcaaacgctctatttcagcttgtaatagttgaaaatagagcgtttgatttatattttgacgttatccattcaaatgaactacttcagaaaaattgttaattgagtaattaattgggtagagataaaatagcttttgccttctacttaccagctaatttattttatctcaaatatttgtttgttctctttataacctttcaccattacttttaatcacctgtttgtaccaatcaaaagattgctttttcattctttttagacttccctttccttgattatctttatccacatagatcatgccatatcttttttccatttctcctgtgccagcagaaactaagtcgataatcccccaaggcgtatagccaattagatttgccccatctaaatagatagcatctctcatattctcaatatgttttttcaaataactaattcgatacacatcattaattgtagaaccagttattttatcaactgcacctaacccattttcgacaataaaaaggggcatttcatacctttcattaagccagttaattgcatatcttaatccaagaggatcaatatgccagccccaatccgacttttctaaataaggattttgcacaagatcttttgattcattgtaatcaaagtacggttcttttccactccccttcactgtaaatgacatataataactaagcccaatataatcgacaattccatcacctataatcttttcatcctcttttgttctatctatagaatagccttttcgctcaatataggtgttgatatagcttgggtaagatcctctacattgaacatctgcgaaccaataacggcgctgcatagcagtgttggcggccaaaatatctttaggattacacgaataaggatagattggtgccatcgcaatcatacacccgatttgaaatttcgagttaattttgtgtccgatattgactgcaagagcacttgccacaagctcatagtgagccgcttgatacatgactttctcccgatcctcatccgctgtataaactaaccccgaatttgtaaatggtgggaaatcctcatcaaaattcgcttgattattaatttcattaaaggtcatccaatacgtcactttatctttgtatcgttcaaaacacgtagttgcaaatcgaacaaaaaaatcaattaattttctattcctccagcctccatatttttccactaaataatatggcatttcaaaatgcgataaggtaataattggctcaatattgtattttaaacattcgtcaaacaagtcatcataatagtttaagcctgcttcattcggtttttcttcatctccatttggataaattcttgtccatgcgatagaggtacgaaagcattttaaacctagttccgcaagaagtttaatatcttctttgtaatgatgataaaaatcaattgcttcatgattcggataattttcgccttctattacgccctttgtaatgcgcctaggcaaggtaactgatccagaagtcatgacatctgcaatacttatccctttaccatcctctttccatgctccttctaattgatgtgccgctaccgcaccgccccaaagaaatgtttcgctaaaaattgccatcttattcacctaaaacctctctcttttacaaaattcagtgttcgcatgtatataaaatttcaaatattcgatctcttaattccggctctaatttattgataatcgctagctcagctaacagattagtcgcttcttttaattcacacaatatatcatttttagagtcatagtccatttctgctagtctaagacattcaacaatgcgggctattttatcgtttgcctgaatttcttctgctttaattttgacagactgagaagtattcgataaaaacaatgggtcaatagccaatctatgaataattatctgatgtactctcgatgctggcacgatttctttatctcctgttacggcgatagtgactgtttttgttgcccagctaaaggagatgctggtaatacaccttttatctccttcgtcctcgattagctcaaactcatttgaatctcctgggaatatatgccaatctatctgcttgggtaattctgtacctgttagtgctggggttggatcaaggggaatgatacttccagcttttgcaaaaacaggcattgtgtctaacggtctaaaaattcctatttttgtatcgcctgaatattgaacatccgtaaaaaaatcaaaccattccccttctggaaaccaaacctctactttggctgtcttatatttatgatttgttttggacgtaatcggcataaccattaactctgtcccaaaaaagtattggttgggaacatgatagctttcttctttcattggataatgataatacattggtgtaatcaacggatagctttcttcatgagttttaacattcattgtatacagatatggcaacatttgatgacgtaacgttaaaaattttttcatgatttgacatacagtctttgagaaagaccatggttccttattattaaaaatgctaggcgagctgtgtaggcgattaattggactgaatacaccaaactgaatccaacgtgtagctaattcttcatcatgatacccttgtctatgcccccctatatcatgactccaccatgtataaccaatattggaagccgtgctagtaaaataaggttgaaaagccaatgatttccatgaaattactgtatctcctgagaaacccactggaaatctatgacttcctggtccagcaaaacgtgacagaataatgttatttttcccagacctgtttatatctttataatgataatgatttagtagccaaagagaatcaaagtcagtcatctcaccctcaatatcctgctgccaatcaatccaccaaaaatcaacaccttgcttttctaatggatgatgtacatcttcaaaataggtttctctaaaggctttatttgacaaatcaaatatggctggttgctctttttcctgatttaaccccagtcgcttacttactgtcggatagcagtcttcaaatgcttggataccgttggctggatgcaggttcagtgttactttcagcttctttttgtgtaacttttctaaaaatgcttcaggatttggaaatagttctttattccaagtatatcctgtccagccacttccaaatctttcaggaacatctgtaatatgccaatccatatcaatcacactcactgacaaaggaacctcttgttcttgaaaggtgtccattaactccaaataagtttcttctgaatacttccaataacgactccaccaatttcccaaagcatatcttggcaataagggtggctgtccagttagatgaaaataagccttcaatgctttaaaatatttccgtccaaaaccgaagtaataaaaatcgaatccttccccttcccgaagtatcgggttatcctcttcatctaacgcaaagctgcttgaatcatctagaatagcaaaaccatttttactaataattccttcagataattctatcgctccatccgttctatccagtgttttaacagttccttttaatgtgttaaatttttcgccaaaataccaacgatttcgatactgggacaaattattcctagattcaataaataaattttttgcagaaaattttccttttttaaaataaacatgaattgcatcagtcagtatctctaatatttcatcattttcaatcacttcaaattttggcggactaaattctctattttgaacgatttttgtccgtctatcctcaaagtggccttcagatgaatattctaatctgattaattcattcgttaaaattgtgattcggtaggtatctccttgaaatacattattcataatgacctcctaaaaaaaatatgatacaatgtgagataatagtaaaaaataggtggtgaacataacatgaaagagtttagacaagcacattcccatggtgattacttgtttccttttgaagtattcaatcaggcttatacgatggccaacatacaaactgtgtatatgcattggcatcaagaaattgaatggattttctgtgaagaaggttctatttctgtctttgttaacggaaaaaaatacattgtggaaaaaggacagatgcttacaattccagaaaaagccatccattatataattacaaatagtgaatgtcattactacacatgtgtatttcaaaaaaaattactcaaaatggacgtattagatggcattacctatcaatacatttgtccttatattaatgaagagctagaaattgaggcagtaatacctgattcgactcatgttatagaaagcttatttaaaaaaatttatactgtcgaacataacagaggcctaacgtatcaattaaaaataagattgcttttactagagctgttttcttaccttattgaaaatcaacatctaaagaaaaatgacaatttcttaaataccgatgtccaaattcaaaaaatttatgcgtatatcgaacaaaattacaaaaaaaaaattacaaatcaacagttatctgctttggtaaattataatcctgaatatttttcaagatattttaaaaaacagtctggttacagtccaacagatttcattaactactatagaatcgaacgtgcttgtgacctcttattccatacaaaactatcaatacttgaaataggaattgaatgtggctttgaaaactgcagctatttcattaaaaaatttaaaagcattaaaggacaatcaccaaaaaaataccgtaaattaatcttagacaatcaccttttaatgtctaagtggtgatgatgaattttcactatatttgttcccctttttcttgttttagtgctaataagtcggcacgtctaacaaaaggaaaccatatgaaataaggaagaacaatattcgtaacaatacttagtaataaaaccctccaaccaccttgtagaaagtcattaaagccaaatggcaaaccaaatataacagaaaatccatttaattttggtaccaatcctgttgatatcgctaagtatgcgacaatatacattaacggagcgctaaataaaaagggcacaatgaaattaaagttaagcatcaatggtatcccaaaattcaaaggttccccaattccaaatatggctggtccaattccaagttttccaaactctctaaactgttttgattttgagcgtaataaatgaaggcaaagagcaatttgatagccgccaaaataaaagatagaaaaaaatgctaatcctgtaatattgggaagtggattcccagctgcagcagcttgcatattttgtgtatctaatgctaataaaattggcatataaaaaggacttaatacattttgcccatgaattccaaaaaaccataaaacctgtgctaagaaagcaaagagcattaaagaaaataaatttcctcctactgactgtaacggtgcttgaatagctgtatagattagttgatgcagacttccagcttgagtaaacgtacaaatataagaaatactactaaaaataatcgctgatattacaaagggaataatacttgcaaaagtattagacaccgcagaagggacgctttctggcatcttaattgtcaaatttttaagcttacatgttttgtaaatatatgccgaagaaatcgcaactagtattgcagtaaatgctccttgagaacctaaccatgttaaaggaatcgctgttacttcacttttttggatgatgtctgaaggcgttaaaatcaaaaatcccactagagaaattacacctgctgtcgctccatcatcattttttaaataacggctagcaatatttttaccaataaaaaaagccatatagatagaaagcagccctaccgtataattaaaggcacttaaaaagatcgttgttaacccaacttcttcaaaaaacttagaaaccgagcctagaggaataaccgctaaaattaacgaaaaagaaccaataatcgtaatcggtaaggtagacatcatcccactagataagccttgcaataaattgttattgctaattttcccagcaaaatcggaaaaacgatcaaacatactggtaacttctttttttatcttttccataaaaaatcccatccttctcataatataattttaccctcgtgcacttaattcaaatcagatatctattattaatgtaaacctttttatttatttattctttactatttttgacagaataatataactattttgacattcatagacaattttcttatttcaagtttatataacatgagtagatagtaagcgtcctataggacgcttacggtcaatcacaagagtcacaggttacttcaaaaaaaaagacaacttgactccataacaagtagaactgataacactagcaagaaaaaaagcagtttgtaatagagaacgatattttaaatgcaagcagcgctgaaattcggatgaaaaaataagtaatcaatgccactaaacataaatactccatacatcaatatgtagaaattttagaagactatcactaaacctattactatcaattacgtccaattgaaaatgaagatgagttagaagcgatcataaaagagtaatttatccataatcaaaatacctacggtatccgaaaactgaaagaatgttagccaatcttagctataattatttgacgaaaaatcggttggaccatgaaacaacaaggattgaaatctatctatactatcgctcattttaaagtttaccgaaaaactgataacgaaagagagaaagcgaatatattggattgagcctttacactagagaatcacttagtgtttttttcagctgaaaatgtctccacaaaatcagttgaaaaataccccacttcatttatcttaaccactgctttgtatcttctactcgaaaagaagaaccacttagatcaagtacgtgcgcccgatgggcgattcgatcgacaattgcagcaataagcatggggactttgaatgtttcttcccatcgttcaaactccaagttggatgtaatgatcatggaaccattggtatttctattagaaagcagattaaagaggatttcactacctacctgatcaaatgacacatagccaagttcgtctaatataaccaagtcatatttactaaaacggcgcttatagtaagtcagctggtttgcactcattgcttcttttagttcaatcacgagattaggaatgcttataaataagacactttttcctgctagacaagcctccattcctaatgtattggctaagtaagttttcccgacacctggatttccaatcaatattaaaatctctttttgctcgataaatcgaagttccttcagttctgtaatcttttttcgaagttttggatccaggtgtgcagttagatagtgatcaaaagttactcggttgggcagttttgatccagtaatcagtcgttggatccggttgcttttgcgattctcaaactcagcttgtaacagcatttctagaaatcccacataagattcagaaagatccaatgcttcttggatcgcttgtgtataattttttcgaatatgggacaatttcaaatgttttgttagtgtatcaatactcataacgactctctccctagataaagtttcgtataggcctgtacttgaattcttgcggcatttacagcttttgttttcggccgctcgcttagtctttcttgacgttcttcaagtgcatcggactctagatgctgcaccagttcttccaacgggactgcctggtagaaggttaaacgttcgataaatcgcttgggatcattttgatgatattggagaaaacaacgatgtaatctcggaatcccctgaagagccagtgaatgtttgagagccttcggcttacgagaaaatgtatgcaagtaatgttggatttgaatggcataattcttactttctttttcaagtagatgccgacaaagggagcgtcaataattttgtgtaaatggttcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaagaattcaatcaagttcgtagagtaaatagtcttgcgtatggctaatgagaaaccatagaaatgcacttgctgattgcgattgagagcaatcgaacgaaagcgagttctctcactagccgttccattcccgtacggatcataaggggtattttgaaaatgactgctcaacgcccactttacatccatcacgctgattttctttttcggaagacagatgaaaggtagatcttggtcaagcggatccgacgcggtttcgctgaactgtttttggatataccaagctctagggttgttataacgagtatctttttctgttgcactgccgaaaatatgacgtaaattgattccttcaaagtctggatttaagtgattgctgacaatcatatcaggtaaatcgtcggaaaataaagtatcttgcgaatcaaaatcgaaggtagcgatattcattcgattcggggcgatcacataagcatcatcaggaattcggatcgctgcccaatgatgtccgccaatcgtttccatataccagatttcttctcgatcggcaaaagccaaaccattagactcataggtaccataagtttctagtaactcgcctaagcgtaagactccttctcgagcagaacggatatagggaagcacgatactgacaaaatctgcttctccaatgccttcttttaccaaaggatcgatagctaaaactttcgcattggtagtgatcgtttctgtggcggtcatggcgacattggcgctgttgattcctgaagcagcccagactccttgagattcatctgcctcaggcgtagaagtataccttaggggatctttcggtaaaggaatactgcacccgcttaaaacagcatggaacgtagcaggctgttgttcaggctggattacgacaaatttttgtggtagggacactgccccggcatcttcattgcgagcaatgagggtcgagccatcgagtgatgcgtttttgcctaccagcatggttgtacaagaagctgatttgcgtgtcattgacaaaactccgatcttcagattattttgttgataattgaacatagtatagcgagtaaaagacaaattgacaatcaactttcgactaaaaattagttcgctttctgtgtgacttttagtaaaataggaaagaaggagtgaagaaaatgaaacgaatcgttatttttagtttgctgtggctggcagggattgggttgagcggctgttctgaagctactacccagacaacaacgactggcagcaatcaagctacagctagctcggtggttaagcaacagacggctgagatctcatttgtgaacaagacagatgcgcagcctgaacaaataccagccaaaacggtgtcattcaaagaaggaacctctttaatggagataatgaaggaaaattttgatttagtggaagacaaaggcatgatcaccagtattgaaggattagcgcaagatgaagcggctggttattattggacctatacgatcaatgacgagatggtcaataccggcgcaaaagatacatctcttaccgaaaaggatcgagtcgtttttacctatgagaaattttaaaccgacaaaaatgtctttttccgtgcaagagattgcttatcttgctttgctagtagcagcatcagtggtggggcgtacattgtttcaaccactgccaaatgtacaaccaatgaccgctattttcttattggtggctctttatttaggctgtgtcagaggactgatcgtcgcattgttatcccttttgattacgaatttttacatggggatggggatttggacgattgctcaggcagtaagttatacagtcgtgatcctcatgatgagcggattaagacatgttcccatcgttaaacgttccttgatcttgcaagtgatttttagtattttagcagggttcctttatggatttgtggtctccttactcagcgtgtatctgctaggcttaccaagcttttggggctattatctgcaaggaataagttttgatacgctgcatgctgttggaaatggcttcttttatggactacttgcgccaatatttcgacgactttttcaccgttattatccagctaaaaagctcatccattagtgcaatctgctgattcagcgctttattgcattcattgctagtgtcattgatctgtctcaaagaatgatcaatgacactggtttttatatcgatatctggcaagatcctccttgtagatgctgctacaagcataattgtgttgttctcttacaaaatcgggtattcttaacctatactggaaagggagcggtttcaatgaagtggatcgtaaaaaaagaagatctagaagcatatcggacgagattcaatgggaaactggctggctatgctgaagaagctaaagtaatggcgattcctttgccaaagtattatatcgtaatcgttgatgaagaaaaaattagtttgattcaattggatttgaactttgaacaaaaagccatggaaaccgtgctgatccatgagatcaccacattgaaaattactggtgtcatgaacaaaaaagtgttgatccagacgccttctaaaactatcaaggttttgattaaaccgatggcgatcggaatcaaagaagagcagcaacagttgatcgatacgtttacccggatggcgagctgactacttattttagaggaaaaatcaaaaacggatcaaacgccaagctggcggattgatccgttcgtttattctggggttcccacaattttgatgtattcatcgatatttttgattttcatatgtttgatcactaactgttcacgtttgttccatttgccttcgacttctagctggtacttgttgagaggtaagcgtaaaacgtaactagaaaggtaacggtctttaataatacagttgatgattttatggtcttctaataattggattccagtcagcatcatcggagtttcttgaaaaacacgactgttgactaacaatcctacatgtgtttcattcattattcgatcctttctgagaaaaataaattctcgaatattcttcttttctatgttacccgatttatctaggaaaggcaattctggaaaaacacctagcaacgcaaatcacggaataaaacaactggtgaagaggaatcactacacgattgaatggcagaaagtttttacagaaaaaagacacagaaaaaaagatacagaaaaaaagacagaataaagagatctgaaacggcgagacaaaaggaatgaacacaaagaatgaataaataagaagcacacgaataaacaaggatttttgatggcgcttaaagagaaagcgtgtgaaaacatatcatttcttaacgtttaaaaaaggcaactttttgtttgaagtagcttagagaaagggagttaagcagaaatacgttcttctagaggaaatggcacctgtaaaagaacgaggactgcaagcttgaaaacaggcatttcagcagatttctgttaaaataataactataaaagaattggaggagacacatatgaaaaaatctggattcgtagtaggtttgattggcgcggcttttggtctggcagtttataataaaatgcagaagatgactgtcaacaaagattctgttaaaggcaaagcaaaagaagctgcgggaaatgtcgttggcaacgaaaaaatgcaagcagaaggaacattggatcaggttgtcggtgcttctaaagaagtactaatggacttgaaaaattctgtgtcctctgccattggggttggaactccagacaaggtggctggtaaagccaaagaggcagcaggcgatatcacggatgatccgacaaaaaaagcagaaggctttgttgatcaagcagcagggcattctaaagaaatcattgcagatcttaaagacaaatctgagtcaatggcacaagatgtcaaagataaattcgaccaaaaataggatgtagtgagagacaggcacagagggcctgtcttttttttgtggctttttttgcaaacaaaaacaatgatcctgtcacctgaagagcgacaagaacgaaggatcgttgtgcaatgatgggatcgctgacaaaagtagtaattgatgcttgacacatgaatgtacgttcatatataataaaaatgtagatatgaacatatattcatttgtaagcaaatgatgcactaactttgaaggaggcttttcttatgtctacccactcttgcaatcattcaacaccacacacccatgcagcagaggcaagccattcccatggcaacgccccgttacgtaattatttagtaggagttattctttttattgctgctttattggtaccgcaattggtcgttaaagatttattatacagtgccgctattcttttagcagggtatcatattatttgggaagggatcgaagacaccatcaaagatacccgcaaaagcagacactttaaaccgaatgttcatttattaatgacattggctgcctttggttcagtattgatcggcaacttcaatgaagctgccttgctgattctgatttttgccggggctcactttttggaagagtatgcagagggccaaagccgcaaagaaatcacgaacctcttgaagttgaatccgacagaagcccgtctggttaaggcagatggcagcattgagaaaattgcagcagagcaagtcaaaaaaggggataggctgcaagttttaccaggggaccaaatcgcaacagacggtaaaattctctcgggaatcagcagcatcaacgaagcctccatcaacggtgaaagtgttccccgtgaaaaaactgtaggggatgaagttttcggaagtacgatcaacggtaacggcacttttatgatggaagtgacaaaagacagcagtgagacagtttttgctaaaatactctctgttgtggaatcggcacaaaacaatcaatcaaaaacagaaacccgcatcaaaaaaatcgagccgctttatgtgacaacggtcttgattttggtacccttatttattttgacagcaccctttctttttggttgggattggtcaaccagtttttaccggggactagtgatgatgatctctgcttcgccctgtgcattagccgctagtgcagtacctgctagcttgtctgctatttcaaacttagcaaaacggggcatcttatttaaaggcagttcttatcttgcaaatatgggacaaacaaaagtagccgcctttgacaaaactggcacattaacgattggtcaaccacaagtgaccgatgttttctttgctgaagaaacaactgaagcgcaccgtcaagagtgggtatcgctgatcttggccatggaaaagcaagcaaatcacccattagcggctgccatcgtagagcattttgagaaacaagaaaaggcacaaccattagaactttccgttaacaaccaaattggttccggtctgacggctgtagttgagggaaaaacctatcgaattggcaagccagcggcgacgtttgcgcattcatcatttgctgagcaacgagaaaccctggaacaatcaggcaaaacggtggttgttttttcggtggatgatcagccagttggactgatcgcattgatggacttaccgaatcctcaatctaaagcggtcatagatgaactgcagcaatctggtattcgaacagtcatgatcacaggagacagtcaagcagctggacaagcgattggtgatcagcttggagtagatcaagttgctgcaaatgttctgccagaaaataaggctcagattatccagcagttgcaaaatgaatacggtcagacagtcatggttggagatggtatcaatgatgcgcctgcattggtacaggccgatatcggttttgctatgggggaaggatcggatgttgcaattgaagtgggggatgcggtgatcatgaaaaatgatctaacacgctttacctacgcactaaagaccgcaaaaaaactagatcggattatttggcaaaatatttttttctccatgtttattgtggcattattgatcgtattgaatttgctaggcaaaatgaatattgggttaggcgtctttgctcatgaaggcagtacattactcgtcttattcaacagcttgcgcatgcttgcaccaatgagtgagacagtcgcccatacatcaaaaaaataatcaaaaaacgcttatgctgatttaatggccatccagcataagcgttcgcttttttattaaacaatgtcattgattgtacgctgcagaagagcgaggaaattggtcgatttttgctaagcgctgatcgattcgtttgatgatgccttctgaaaactcgagattccggatagaagagcgagccgcaagcaataattgtttttcttgcatcaaatcttcttggattcgatagatattggctaagcgttccacatattcataatgggtgtagtccgtctggctgatcaaaaacttcaatagatctgctgcctgcatatacgcttcttgcgtataataagtgatcgcttcccggtataacttgatttcaaattcttcgattttttgggaatttgcttttaaatcccgccattcgttgattgaaatttttttttggatatttcccaaatcgtcatacaaaaaaatcacagggacgtcattgggatgttttgtttcttgtttgatttttttcatgtcgtacctcctgcgttttttgctccgtttttactgatcatttctcgttgatacagtctattgtaaaagcaaagcaacaaaaagtctacatgaagatgtcaaaagaattgttcttttagcgcattctcatcttaataactacgttttctttgaaaatgattgattaaatccgagatccccataaaaatcaagactccgccaaaaatttggaagaacaaaagccacgtttgaaacggattgaaaacaagaatgatacctgccacaatcacgaataaactgaaaagcaaaccagtgataaatggtaagccattgcgtttttgattaaagcttgccatcaaacgcgtacagccactgatcgtgatcatgattcccaaaaagaatggtacgatcgataatagtccctttgcaaaaacgagaatagctgcggcggcaatcaaaagcaggatccccgttgtcatctgcatattcacatagccggtttgccgtttttctttgtaactggaatagaggttgatcaccccaaggcaggcaacatatccggcaactaaatagacaatcgtattaaagacactgcgaggagcaatcaaaataatcaatccagcaatcaaaaataaaatcgctcgtaataaatcgtatcgttggattttctcgaaaaaagtattcataagttcagttcctccttttttttactattgtagcggatttctttcaaaatagaaaatagaaacgcgttgtaggataattctgcttttgaagcagcaaattatttggtaagatagatgaaacaacaaagaatggagaaaactatgagtgtattaacgcttttaatgtgtctgttcacggtcgtcttgtatttgtttctcgctgtcgtccgcaaagacattcaaattgttgcagccagccgtaaaggcggaaaagcagcaattgctttcttttcattggtggtcattatagcaatgttttttatggaagaaacctttgagaaccgcttgcgaggggtcgtatctggattgcttttcttaagttttgtttttgatagcagagggttagctgaagatcgattcattattcatccactaaatattcgcgggatcttgtatcaggaagtggatcgggtggtactgtatcaggagagcaaggaccaatggatcaaaatgaatttctttcgaagagggatgcgaggaccactgttgaaattcgagcgtccaatggaagaattggtcctgtttttgacggagcatctaaatgaaggaacaccgatcgatattctagttgatcaagagccaaaaggtcattgaatttctttaagcgatcatataaattgagagaatcaattggccgggcccctttgactgcaaaagcaaagagacccggtcaattttttaatttaagggactatccagttgatttttttggcaaaattcgagtacgccgaatacaggaagcaagctaggtttctgaccgaacgttttgctattttttgtttaagaagaacagggtcttacccttaaataaagggaatatggtagaattgagtatcaactttattgttttaattgaataggtttacatacaaaggaggacgatgctgttggtacaaataaaagaggtcctcaaaaccgttttgttcgttgctctgtttgggctgttactgttttcgttgcgacaatacgtcttcactcctgtgatcgttaaaggagattctatggatccaacattgcatgatggggagcgtgtgatcgctatgaaaaacacccagatcagccggtttgatatcatcacatttgaagcccctgatgaggtgggaaaaaactacattaagcgtgtgatcggattacctggtgatgtggtggaataccgtgaagacactttattcatcaatggggcagcatatgaagagccttatctttctgcttttcgttcaaaattaaccgatggttatccactgacttctgactttacgatggctgatttcggtgttgaacaaattccagaaggaaaattgttggtgttaggggacaatcgccgaatctctaaagacagccggaccattggtttgattgatcagtcagccgtattaggagatgtcaaatttattttttggccccttaaagatttcggaagcattccgaatcaacactctgagtaagcggaagtccgactcgctcagagcttttttttaaaagaaaatttgttatactatttgttatgaagacaatggaagaaaaattgtcaacggatcaatagagagcatcaaaactgttatttttcatgagcaggtttggtagatgcaggagttgatctttacttacgatagaaacgacgataaaagtaaaggagtcttcgtatgagtttacgatttatactaggcgatggacgctgcgatcacgaacaagcgattttggacgcagctaacgcttggctggaaaagccacaaacagaagtcttttttcttgtccctaactacaataagtttgaacgagaaagagagattctgcaggcgctaaaacaaggcactggagattttgcctcgattcgagctcaagtctatagttttcaccgtctggcctggttctatcttcaacaaactggctggttgtcaaaaacggccattacagataccggtgcaaccatgatccttcgcaaaatacttctcgatttggaagaggagttgattctttttcgaggagaaatcaataaacctgggtttattcaacaactgttgtctctttatcaagaaatgcagacaagtaatatcgcaaccgaagatctgcatctcggtggaacgatgaataggagcaacggagaggatgcgttaaagttttccgaactcgcattgatctttcagcgtttcgaattagaaatggtgacccgggaactgcaagtggaacaaccgctggcactactaacacgttttctgcagcaagggtctaaacccaatgaattaatgaacgatcggcctgatctttcggaatcattatttatcatcagtggtttttcagcattttcaactcaagaacagagtgtattaaaagaattgatgaaacatgggcacgtcgttgtcgatttgcttttagatcatggatatccccaagaattaccttcaccattagatttgttctatgaatcgggccgcagttaccatcaattatttcttgatgctagaacggaaaatgtcgccatttatttggatcaaaagctttcaccttctgaagcacagcaagtgacactagagaaagctgccgcatacaatgaagtggaatccttttggcgtaaaacccagaatcagctccattatcagcagcagcaatcagtttcaccgtatctagaaatgtggaaagttggcaatcctgaagaagaagtccggcagatagctgcgaaaatccgcgcattgatcagcgagcaaaaaggagcaaaactgcgttatctagacattcaagtcttgacactgcaaccagagatctaccatcaatatattccaacgatttttaaagaatatgaaattccgttttatattgacgaagagcaactcatggctcagcatccgctcgttgaattcttgaatgccttctttgcttgtgcagattatggctttcgtttaaatgacatttttcgactgttgcgtacggaactttatttgccaccagcattccaacaacaagaagactggctggctgcccgggatgcatttcgacaattagtagacattacagaaaaccaagcactggctcataacttccaaggaaaagattggacccgtgagagagactggctcttagtggactatacattgacaggagaaaacgcatctggcatcgctgaattgacagattatacgaatcaattgcgccgctatttccgtcaagatatttttggctccttaaaaaacattcaagagacaaagacgaaccgggaagctgcaggtgctttataccaatttttactttcagcaggtgttgaacagcaattgattcattggcgagatcaagcaatctcacaagggaaactagagcaagctcgcaaccatgaacaaacatggcaagctttgatcgatcttttagatgaatttgtggctatttatggcgatgatcctttcgaacagtcactctttgaagaagtattgatgacgggtttggagaatctgactttcgggaaaattccgacagcaatcgatcaagtcaatattaatcgttttgatctagtacgacctcggcaagcaaaaatcactttcgtaccaggattgaatgagacggtgttgccaagaaggatcgaaaataaaacattgttgactaacgaagaaagacaacatctcaatcaattgtttgcgggagaaaaatatctacgcgatacgattatcgaaagtagcgccaaagagccgtttcttttttatgcgatcttattgtcttccacggataaactctatttgtcttatgcatgcaattttgatacccagcaaaatatcaaattgtccccatatctggctcgtctgcttgaatggttagatgtttctttacaagaccggggcatcttatctttaaccagtgatccagaagcctacgtcggcacgtatcggggattaatctatcagttgaataatctaagtcagcaggcaagaaaagaacgacagaatttgccggcaaagtggcaacggttcaaacaggctttattgcattcgcctgaaaaacaattagcccttagagtatttgaaagccagacccatcaaaacattccagtcccgttgtctcaagataaagccgttgctttatatgggccatccatctacagttcgatctcgcaactggagacattctaccagtgtgaatacaaatattttgtcagttatggactacgcttgaaagagcgggaaatctatggacttaactcagcgatgactggtgaatttttccatgatgcactcgatcgctttgtcaaagtattgatcagtgagaacatctcattgacgcagttgaccatggatcaacggctccaatttgttgaaaaagtgttgcaagagatttttggagaagtccgctatacattattgtccagttcggccagaatgaattttattcgttatcaactaggtaagacgattcagcgagtagcttgggcattaacgaagcaaggacaaaaaatgcacttctcaccgcaaaaaaccgaagtactgtttggacagatcgctggcgctcaagggatcaatggcatcgagctgcctttaagcagtgggggcaaactgcatgtgcgaggaaaaatcgatcgggtagatgcagcaaaaaccgaagaagagcagtggctttcagtcgtagattacaaatcaagcagtcgtgaatttgatttgacagaagcttactatggcttagcaatgcagttgatcacttatttagacgttgcgctgaatgatgctgtgcagctagttggtacagaaaatgtgcgcccggctggggcttattatttacatgtccatgatccagtcttagatggtcaaaaatcctctgaagaggaacggttgaagcaattcaaatatgatgggttgtttctggatgaaccctcattgtttccacttttggatcatgaattgtcagacagcagcaattcggcagtttttccgattcgcaaagacaaaagcgggacgtaccaaaagacaccacaagccaaaaacaagttttacactgaagaagagattcgcttgttgaggcagcacaaccgcaaaaatatgcagcaaggtgcggagaaacttctcagtggcgaaattgccttgaatccgtcttataagctgaaagacaaaaagcgcgcctgtgagttttgcccatttcgcagtatttgcgatttcgatgtgatgctgcaagaaaataattatcatcgtctagagaatttatcgaaagaagaggttttacagcgattaaaggaggaggagaatgactaagatccctctaaaaccacaaaatgaaacatttactgatactcagtggcaagcgatctttgataaaggagacaatctccttgtttctgcctcagctggatcaggaaagaccaccgtccttgtgcgacgtgtgatcgagaaattaaaagcaggaattcagatcgacgaattgctgatcgtgacctttaccgaagcagcagcaagagaaatgaaagaacggatccaagtagctctgcaaacggccattaatcaagaaagccaagagcaaaaaagacaacatttcgttcggcagttgcaattattacctaccgcaaatatctcaacactacatgccttttgtttaacggtcattcggcgtttttattatctgatcgatttggatcctggatttcggatgctgacagatgaaacggagattttgctgctgaaagaggaaatctggacacaattacgagatgcacactacgaagcaaatgatgaagccttctttcgattaaccgaaaacttcgccagtgatcgttccgatgagacggttggtgatttgattttgtcactctatgattttgcccgcgccaaccctgatccagaaaagtggctggacggtttagcggtaaattatgaagccgcggacaatttaggggagaatcacctctatcaggctcaaatcaaaccgacgttggtagaaattgccgcaacggcagagcatttgctggcagcggccaaacaatttgcagatcagtcaccattaatggaaaaagcagcagcactcgttcaagcagagatttctcaagtccaagaaattcaacgagttctggcaacagacgatctatccgtcttatatgatcgcttgactcatttgacctttgatcgctacccaagctatcggaaagaagaacaaaaagaactttcacaggaaatcaaaccgttgcgggatgatgccaaaaaactattagaacaactcaagggatattttccttatccaccagcagacatgctgcaaatgctgcaactatctgaaccgatcgttgcgactatggcagagatgaccaaagagtttttgactgcttttcaagcccgcaagctagcaaaagggttgttggatttcaatgatttggaacatttcacgttgaaaatcttattgggtgatggcacaggcagcgatgcttctgtttattaccgcgataaatttgaagaagtgctcgtggatgagtatcaggatatcaatcgactgcaagaagcgattctgtattgggttcggcaagtttcaggagaccatggaaacatgttcatggtaggggatgtcaaacaatcgatctattcatttcgcttagcagaccccactttgtttatagaaaaatatttggcatttgaacatcaaaacgggggacgaagaatcgttttagcagaaaatttccgttcgcgccgcgaagtgcttgattttacgaacttggtttttcaacaattgatggacgaacaagttggacagatcccttatgatgacgcagcggctttagttccgggatttccgagttttcctgaaagcgacgcattcattccggaacttttgctctatgaaaaagaagctgaaagtactacgaatttgattgaagacaaaacggaaggagaacttcacgtcaccgcaatcaaaattcaagaactgatccaatcccaatttatgatctatgataaaaaaagacgggcagaacgtccagtcacttatcaggatatcgttttactgactcctacccgcaaaaataatttggtcatcttagatgttttcaaaaaattcgggattcctctggaagtcaatgatgcccagaactattttcaagcaacagagatccaaacaatgatcgcattgttgcaaatcattgataatccttatcaggacattccattagtggctgttctccgttcacctatggtagggctaacggaagacgaactagcagagattcggctagcggatcgtaccagtgagttttacaaagcggtcttgacttatcaagacaaccaaaaggggactgtttccgctttaagcaaacgagtggatgattttttaagcgaattgaatcgttggcgggaagcagctcgcagactgccgatccctgatttattatgggatatttatgatacaacggcttacttggattacgtggttggcttgccagcagggcaacagcgctatgccaatttgattgcattgatccaccgagcagagaaatatgagaaaagcagtttccgaggattgtatcaattcattcggtttattgaaaaaatgcaagaaaaagataaagatttggcagaaccgttggcgacgccagctgaaaatgctgtgcgggtcatgactgtccatgctagtaaagggttggagtttcccgttgttttcttattggatacaacgaaatttttcaattaccaagactttcaaaagcgttatatttttgaagaacaacttggcgcaggtatccaatatatcgatgcttcggaaaatatcaaatatgaaacgattccttttcaagccatcaaacaagttcgtttgaaaaaagccctctctgaagaaatgcgtaaactatacgtagcattgacacgggccgagcagaaactgtatttagttggttcttataaggatcggcaggcagcctttaaagcttggcaagcggggttgacacaaagtcagacagtccttgacccggctttacgtttagttgcaagaggcagtctaatggattgggtcggtttgacattgattcgtcatccagagatggagcagttttttactgatgccagtgaacgaaaaatgacgatccatcatcctgcaagattccagatccattggtggaatcaggatcagattgatcagcaattgcaggtgcagccgccaacagaggcagttgtggctccgacaccaagtactacagccccagaaagattgctgaaccgtttagactatcagtatccttacagcaaagcgactcaaaccaccagctatcagtcggtctcagagttaaaacgtctatataatgatccggacgatcaagatattactttactggaatggcattccgcggatcaaaaattggcacctcagcgctttcgttatgttgagactgaattagctaaaccgcgttttttacaagaacaaaaaccgcaagctgcttcgatcgggagtgctacgcatctagttatgcaaatgctgccgctgactgaagtaccgacggaagcatccttagcagcttttatcgatgaattggttgaacgtcagctctttacgaaagatgttgccgacaaaattgatcaagcgagcatcgtgtggttctatcaaacagccgtggggcaaactttgatcaagtatgcaacacaggtaaaacgggagcagccattttcaatgctaaaagaagctgccactatttttgaaggatttgatgaaccagatgccgaattattgatccacgggattattgatggctatgtggagttgccagatcgaatcattttgtatgattttaagacggatgctgtatttggcagtgaagcacagattgaaaagcgcatgcgggatcggtattttggacagctaaaactgtattgccaagcgttagaacaagctttgcagaaacctgtgactgagacatatctggttttactagccgctaagaaaataatcgaatggtaggccctcgaacgggattccttacaattcgtaagcgatgtgctataatgatgcaaagaggtgatagaaaatgataaaagtggaaacagattacgccctttgtcctaaatttgaaaaagctttttcgattctagggaaaaagtggaatggcttgatcattgatgtgcttcttgaagatggcaaacaacggtttgtggatcttgccaaaaaaatcccccaagtgagcgatcgggtattggtggagcgcttgaaagaattagaacgtgaagaaatcgtctgcaaagaagacaatctttactgtttaacaccaaaaggggtcgcacttgaaaaaagtatgatgagtgtgaagcgctgggcagaaacttgggtcagagaagaagaatgcagttgatttctggcaaataattaggtacactaaggtcaatcgaatagttaaaaagcgttgatggaaactagtagtttggctgaaacaggaaagggagacttgtcatagactgaaagcaagttctgtattcgaaaaatgaatttcatttctggagcttactgaacaagaatcagtcggcagtcctgctgtcgttagtagaagtgagtgcgtggactttgtccacgaatgaggatggtaacacgagacgtcgttccttttttaggaacggggtctttttttcgtcttgacttatcagctattcacaaagaataaggaggaaaaacatgtctttacaagagaaactagagtcattgaaagaagtaacgctttcaaagatcaaagaaagccgttcaatcaatgaattgaatcaagttcgtgtggatgtccttggtaaaaagggacccatcacggaagttttgcggggaatgaaagagttgtcagcagaagagcgtccaaaagtcggcagctatgccaatgagatccgggatgcgattacacaagcgattgaggaagcaaaaacttcattagaagcagccgcactagaaaaggcattggctgaagaatcgattgatgtgacattgcctggcaagcggatgccacaagggacccgtcatgtcttgacgcaaatcatggaagaaatcgaagatatttttgtggggatgggctatcaagtggttgaaggattcgaagtcgaaaaagatcactacaattttgaacgaatgaacttgccaaaagatcatccagcaagagacatgcaagatactttttatatttcagatgaagtcttgattcggacacacacttcaccggtgcaagctcgtaccatggaaaaacatgatttcagcaaagggccattgcgaatgatttcaccaggaaaagtattccggagagacaccgacgacgcgactcacagtcatcagttccatcagattgaaggactcgtaatcgataagaatgtgacgatgggtgatcttaaagggacactagaagtcatgatgcaaaaaatgttcggggctgatcgcagcattcgtttgcgtccaagctacttcccatttacagagccttcagtagaagtagatgtcagctgtttcaaatgtgggggagccggctgtaatgtctgcaaacacaccggttggatcgagattttaggcgctggaatggtacatccgaatgtattggaaatgtccgggatcgattccaaagaatactcaggttttgcatttggtttaggacctgaccgggttgcgatgttgcgctatggcgtcaacgacattcggaatttctatcaaaatgatgtacgtttcatcagtcagttcaagggggaataaatatgttagtatcttacaaatggttaaatgactatcttgacctttctgagatctcaccaaacgagctggcagataaaatgtcagtcacagggatcgaagtcgaaggaatcgaaatgccagcagcgggattgaagaaaatcgttgttggggaagtcaaagaatgtgtgccacatccagattcagatcacttatcgatctgccaagtagatatcggtgaatctgaattatcacaaatcgtttgcggtgcgccgaatatcaaaagcggcatcaaagtgattgtggcactcccaggttcacggatcgcgggcaatgtcaaaatcaagaaagggaagatgcgcggacaacaatccaatgggatgatctgttcgctgcaggaattaggctattctgatagtgtgatccctaaagaatatgcggagggtatttattacttgcctaccgatgccgaagtggggaaggaagtctttccctatctcgatatggatgatgccatcatcgagttgtcgatcactccaaaccgggccgatgccttaagtatgcggggggtcgcttacgaggtaggagccatttatcgacaaacaccaaaatttgagaccattcaactgaatgaaagtgctgtgaaagccgcagacaagatcaaaatcagcgtagaaaatcaaaaggatgcgccagcctatcaaattcggatcattgaaaacgtaacgattgcaccaagtccgcaatggttgcaaaaccgtttgatgaatgaaggcattcgaccaatcaacaatgtcgttgatattaccaactatattttgctgctgtttggacaaccccttcatgcattcgattatcaaaaattgggcagccaagaaatcgtcgttcgccgtggcaaaccgcaagaaacgttggtcactttggacggagagacacgaacgctagatgataagaacattgtgatcactaatggaaaagaaccagtcgctttagctggtgtcatgggtgggttagattcagaaatcacacaagataccacaactgttgctttagaagccgccttgtttgacccactagcgattcgtttgacgtctaaaaaattcaatttgcgcagtgagtcatcttcccgtttcgaaaaaggcatcaatcaggctgcgatcgcggaggcttgtgatgcagccgctgctatgattgcggagctagctggcggtacagttctacaaggtgctgtcaaaggcgctgaagtgacccctaaggatgttcaagtcacgatcacattagatcggatcaatcgctacttaggaacacaaatcacgattaccgaagccaatgagatttttgacgccttaggttttggctaccaagaaaatgaaggtacctatcaagttgtggtcccacctagacgttgggatattcagatcgaagctgacatcattgaagaagtcgcccgtatctatggctatgaccgtctaccatcgacacttccaagtggtgagacagttgcggggagcttaaccaaagaacaacgcttgactcgcaaagtacgaacactcttagaaggaaatggtttgagtgaagctatcagctatgcattgacaaccgaagaaaaagcccgtcaattttgttggttagagagtcaggttacccgtctggattggccaatgacagaagagcgtggtgtcttaagaatgaatctactttcaggactgctggacgacattgcctataacttggcccgcaaaaatgccaatgttgcgttgtacgaagtggggcgcgttttttacaaaacaagtgatgaccctcgggagctaccaacagaaaacaatcatctaggactagccatcactggcgccatcaccgaaaaagattggcaagaagctgaacaaaaagtcgatttctatcatattaaagggatcttggaaaacttgtttgcaggtctttctcttacggatcagattacttatgaaaagacaacagcaatcaaagaacttcatccaggcagagccgctgctatcctcttacaggatgaagtgatcggttacctagggcaagtccatccaagtacagcaaaagcttatgatctgactgagacatatgttgctgaattggacttggatcgtttgttagcaactgataatgcagcgctcatttatcaagcagtttcgaaattcccatcagttaaccgggatattgcactgttggtggatgagaagacgtcgaaccaaacaatcctgcaaaccattgaacaagcagcaggccgtttcttgacggacattcatctatttgatgtgtaccaaggaaagaacatcgatagcaataaaaaatcaatggcctatcgattgacttttgctaatcctgaagcgacattgacagatgaagaaatcaatcaagcaatgtcgaagatcacacgtgtgctagaagaatcactacaagtagaaattcgttagtcccattgctgtgataggaaacagtgacataaaaaaagagtgatcttgaggaatcagcaagattgtagcatttgcaggggaaggtgttctcccttgctatgctacaattttttttataatggatagagtaaatattctcatggataaccacagctcgaagagttgcttttccagttttattttatggaagaaaggatcgattgatggaacaactgacggtttacgatgcacaaaagcagccaacagctgcgacgatgttgcgggatacgccagtccctaatgacggctaccgagttgtggtgtctgttttattgtttaatgaagccggagaattactgattcaaaaacgacaatccacaaaaaaaggctggcctagttattgggattatcctgctggcgggaccgtcaaagctggtgaaagctgttatcaagcggcagaaagggaactattagaagagttagggatgacactttctttagagaaaatccctagtcgtttaacagtgaaatttgaagaaggctggaatgaactctattttgttcaatggaccggcgctaaccctgaactttgtttgcagtaagaagaagttgctgcagcaaagtgggtcaatgaaaaagagtatcgcgcattgatcaatgggtataaatttattccttacttatatgcaccgatcgttttctcgcttcaaagtcatcctggggaatattttccggtctaagttcttactcgtgatggtagcttctttttgatagaaagcgattctgtcgtgattgagaaaaatgttctcgaatggtgtttgctcacatgtcaatggtagttgagcagttcgcttttttatttagggatctttaaataaaagatagtaattaaaaacaaacccaccaagcatactggtgggtttgttggttgttcatatttatgcaaagtagttgatccccattgcttctttcacttctgccaaggtttgtgctgcgacttgttctgctttttcgctgcctttttttaagaggttcatgacttcagccgggtccttagcaaattcttctcgtcgctgacggatcggagcaaattcttcttctaagacatcgatcagatagcgtttgatttttacatcgcctagaccgccttgacgatagtgctctttcaatgcagcaattttttctaaatctttgccgaagacatctaaataagtaaagaccatattgccttcgacttggccaggatctgctacatggatatgatttggatcagtgtacatgctcatgactttcttttgaacgatatccgcattgtctgccaaatagattccgttgttcaatgatttgctcattttaccatttccatcgataccaggtaaacgtcccattcctttaggcggaagaactgctttaggttccaccaatacgtcactatagatggaattaaagctatgaacgatttcttgtgtttgttctagcattggtttttgatcttcaccgacaggaactaagttggctttgaaagcagtgatatctgctgcttgtgagacagggtagatgaagaatccagttgggacaccttccccaaatttcttttgttcgatctcggctttgacggtcggattgcggcgaacccgtgccacactgactaaattcaagtaatacatggttagttccgacaactgagggatttgtgattgaataaataaagtcgagcgggtcggatcgagaccaatcgctaaatagtcaagtgccacttgcaagatattttctgacactttctgtggatttttggcattgtctgtcaatgcttgcatatcagcgatcatgatataaagttgattgttagggtcgtcttgcatctcaactcgtttttttaatgagccgacataatgccctaaatgaagttgccctgtaggccggtctccggttaatattgtgttcacgtttcatccacctctaaattcaatatatagttcatcttaccttgtttttccaaaagaaacaacttgttctactaagggtcgaaaaaaaacgatggacaaaaacctaacatgaggttaaaataatgaaggtttttctttggggatgatgtggaaattaaaactacctttacaaatagaaaaattttgagctataatatgaatcaaatcttttcaattactcatttatttttaaatatagacttggagtgtgaatgaatggcaatgatagaatttaaagacgtggaaaagtactacggcaaattccatgcattaaaaaacataaatattgaatttgaaaaaggtgaagtcgttgttgtgattggtccttcaggatccggaaaaagcacgatgcttcgcacaatcaatggattagaaacgatttcttctggtcacttactgatcaatggcaaagatcttttcagtaaagatgtcaaattgacagagattagaaaaaacatcggaatggtcttccagcatttcaatctttaccccaataaaaccgtgttagaaaacatcactttggctcccattaaagtattaaaacaaaatgaacaagaagcgattgccttagccgaaaaactgttgaaccgtgtaggcatgctggacaaaaaagattcttatccatccatgttgtctggcggacaacaacagcgggtggctattgcccgaggattagccatgacaccagaaatgttgcttttcgatgagccaacttctgcactggatccagaaatgatcggtgatgttttagacgtgatgaaaaaaatcgccagtgaaggcatgtccatgatcgtggtgactcatgagatgagttttgcccgtgaagtagccgaccggatcgttttcatggcagaaggccaagtattagaagatcgtcgcgacgtcgatggcttctttgaaaacccaagagacgaacgggccaaacaattcttaagcaaggtaaccaatcattaggaggaaagtagctatgagcaaaaaaatcagtacagtgctgctccttgtattcgcgctcatgaccttttctgcttgtaaaggccaaagtgctgcagaacgtgatgtgttagcgagcagcaaagaaagcaaccaaatcatctggggagtcaagaatgatacccgattatttggattgatggatattgcgacagctgaagtccgcggatttgatatcgatatcgctaaagcaatcactgagcatattttaggacgtgacggaagtgctatttttgtcgaagtcacatcaaaaactcgaattccgctattaaaaaatggcaatatcgatgcaatcatcgctacgatgaccatcacggatgaacggaagaaacaagtagatttttctgatgtttatttcgatgctggacaatctttattagtagccaaagatagcccgattcagggaatcgaagatttaaatgccaatacgacggttttagtcgtcaagggatcgacatcagcgatcaatatccgcaaggcagcgccggaagcaaaaatcttggagttagaaaattatgccgaagcctttactgcattacagtcaggacaaggcgatgcgatgacgacagataatgcgatcttattggggatggccagtgaaaatcccaactatcatttagttggcggtacatttacaaatgaaccttacggaatagctatcgataaaggacaagagcctttcttgaaagccgtcaaccaggcattgaaagaaatgcatgaagacggtacgtatgatgaaatttatcagaaatggttccctgatgatgcatctgggaaagttgattaaaggaggaaatttgcatgcttgaattgtttcaaacttacggcgaccagtttttttctggtttcaaatatacgattttctccagtttactggctttattctttagtttagtgattggtacattgatggcgatatttcagctgtctaccaatcgatgggtcaaagggatcgctaaagcgtatgtcgagtttttccgaaatattcctttgttgatcatcgtgatgttcttttatgtcgtggtgccgatgtattgggtgacttttgatggatttcaagcgggaacgatcggcttgaccatctatacgtctgcgtttattgcagaaacgattcgttctggaatccagacagttcctaaagggcagatggaggcttctttgtcctctggattcacttacagccaggccatgcgctacattattttaccgcaggcttttaaaatcgttgttccgccactaggaaatcagtttatcaacttggtcaaaaattcatcgattttagcaatggtagctggtcttgacattatgtatcaaggtgacttgattgccagtgaaacctttaatactttcgacacctatattattgtcggaatcttttatttgattatcacattaccattatcctatttaatggtttatcttgaaggacgttgggctgtacgctcatagaaaggagacactaaatggaatttttcgaagctttttctgccatcaatcttcggtttttgatcgacggtctccgagtaacgatcgaagtctccgtcttatcgatcatctttagttttctgattggcggccttgcaggagtcttgcgtttcactaacattccgttcttttcaaagattttaggtgtagtgatcgatgtgattcgaaacctgccgttgctgctgattattttcttcacgtactttgcattgccgcagatcggtattcgtttcaatattttctggtctgcagttgtggcattgacgatttttgaatctgccatgctctcagagatttttcgagcggggcttaatgccgtaccgaaagggcaaatggaggctggtttgtctaccggtttgagttatgtccaagtgttgcgaagtattgtgatgccgcaagcttttaaagccatgctgcctgcgatcgttagtcaattgatctcattgatcaaagatacgtcattggcagtgattatttcacttccagaactgactcaccatgctcgaattatttatggacaaaataccaattatgtattgccaatgtttcttgcgatgactgtgctgtacttcatcgtctgctatgccttatcgctgctttctcgcttcttggaagcacgtcagtataattactgatttcttgaggctgcatagaaacagtgattactagatccgaatgacctttgatgtcatgcagttgctttccttggacgagagtagccagagcatcggaggttttcggatctttttttgaccgcaataggttcattgttttcttggataaagcaatacttgaaaaatcagtaaaaaaagtccaaaatggaacttagacaaatttctttctttcattaaaaaggatggacaactatgacaaataaacaacccattggctttatcgattctggtgttggcggattgaccgttgttaaagaagcgattaagcaattgcccaatgaacatattatttatcttggtgatactgcacgctgtccctatgggccgcgtccggcagaacaagtcatcgagtatacatggcagatgaccgaatttttattgcagcaaaacatcaaaatgttggtgattgcttgtaatacggctacggctgtcgcattagaagaaatcaaagaaaaattatcgattccggtaatcggagtcatactgcctggctctcgagctgctgtcaaagcaacaaaaaaccaacagatcggtgtcattggaactgcgggtactattaaaagcaatgcgtatgaagaagcaatcaagcttaaatcacctcgttctatggtagttagcttggcttgtcccaaattcgcgcctatcgttgaaagcaatcaagcgcaatcatcggttgccaaaaaaatcgttgccgaaacactgcgccccctcaaaaataagaaattagatacgttgattttgggttgtactcattatcctttgttgcggtctttaatccagaacgagatggggagccagatccagctgattgattccggtgcagaaacagtgggtgaagtcagcatgctgttggactactttgctattgccaatacaagccaaatgacccaagaaccggaatattttttttatacgacaggttcaacaaaattatttgatgaaattgcgaacgaatggttgaatgtaccggtccattcgcaacatatcacattaggaggaaattaaatgcgccatgatggcagaaaagcgggaagtatccgtccagtagaaatcaaaacaaatgtattcaaacatccagaaggatccgtcgtgatctcatttggtgataccacagttatttgttccgcaacgatcgaagaccgagtgccgccttttttacgggactcagggaaaggctgggtgacggcagaatacagcatgctgccgcgagcaacgaatacccgtaatcgtcgagaaagtgcaaaaggaaagctgtctggtcggacaatggagatccagcgactaatcgctcgttcgttacgggcagtggtagacttggaaaagttaggtgaacgtagcattgtagtcgattgtgatgtcatccaagcggatgggggcactcgaacagctagtatcaccggtgcttttgtggctttgcgattggcgatcgatcaattattgaccaaccatgagctaacggaagatcctattaaagaacatcttgctgccatcagcgtaggaattttacctgataacacttgtgtcactgatttagactacgaagaagattctgcggctgctgtagatatgaatctcgtaatgacagagtcaggccgtttcattgagattcaaggaactggggaagaagcgacatttgatggtcagcaattgaacgaaatgctgatttatggcaagacagccattgaagagctgattgcctatcaaaaagaagcattgctgattcaagaacagccccaatacgttattcctgagaagacgatcgtgattgccactggtaatcctggcaaagcacgagaattcaccgcagtttttggtgctgctggctatgacgttcggacattgaaagattatcccgcattacctgatgttgaggaaacaggaacgactttcgaagaaaatgctcggctgaaggcagaaacgattgcaaaaattcttgggcgacctgttctagcggacgattcgggcttaaaagtggatgcattaggtggtagacccggtgtttactcggcacgttttgcgggtgaacaaaaaagcgatgctgcaaataatgccaaattgttgtacgaattaactgatatcccagatgaacaacgaacagcacaattccattgtacattggtctttgcagctcctgacaaagaaagtctcgtagtcgctgccgattggccaggcagaattggccgcattcctcggggagagaacggttttggctacgatccattgtttatccctgttggttcagataaaacggctgctgaaatgagtggagaagaaaagaatcaagtgagtcatcgtggtcaagccatcgcgaaactacgcaatgtatggcaagagtggttggaaggagaacaagcatgaaatatttaatcgttagcgataaccatggcgatcgtcaaattctcgttgatttgctagcagaattttctgggaaagtggatacctttatccattgtggagattcggaactgcaaccaagcgatcccctttggcaaacctatcaagtggttggcggaaattgtgattacagtccggaatacgaggatgcaaagattatcaaaacgcctctcgacacgatttatgtgacccatggtcatttggcagatgttcgttttggcgtgacaacactcggacttcaatcacaacaagctgatgcgtcaattgctgtatttggtcacacccaccagattgcctgtgagaaggtggggcatcgactattcttgaatccgggcagtatttctctaccgcggggacctattcaaatcaaaagttttgccatcatagaaagtactgaaaagcagtggatcgttcaatattatgatcgtacgtttaatgaaatcgctgatttgcattttatttttgagcgctaagaaagcgaaatcaaaagtaaaaaattcattataaataagcagttttacgatatctttttgatttttctagtaaaatagaaaagtagctgtgaaatggaggcattcagattgattggtcaaacagtagaaaaaatattattagaaaatcaagaaagttttttagtacctgcagaaaacgttgcaacggttctttacaatcatccattaaaccatgcgttactcgttttatcgaaagtcggctattccaagattccggtcctagatagtgaggatcatcttgttggattgatcagtttatcgaacgtggtcgaaagaatgatggacctgactgggtttagtatggacaacttagaaggcttgacggccgcagacgtgatggaagtcaatgtggcttgtatcaaagaagatggcgaattagaagacatgcttcatctcttagtggatcaggcatttttgcccatcgtcaatgaggaaaatgtctttgtaggaatcattacccgaaaagaaatcttaaaatctgtcaatcacctagcacatgaattagagaaacggtatatgctgatctcaaaagaggccagtcctacagacgaattacaagtcatctaataatggataaaaaagcaccccgaaaaaatcaggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtagaannnnttttgtagaaaaattaaataacctaggattctaatcactaggttatggtttaaattattaaattttcaattctgccccttttttgccccttgacctgttatctattcaaaataggtcttccaaaaggctatctaatagggattcaatcagacacatggagactcctgcttagtgctgcttccttccggatctgacacgcttcacaagacctccattgtcctagcctttcggcaaaatttagtataacgtatttttctatagattaccagactttttttgttttttcttttggcgcaatgcccgaaaaaaatcttttagcacttgcccgcacgcttcttccaagatcccgccttctacgtaggaccaatggttgaaacgctcatcttccaacagattcagcaaagaaccggcagcaccgccttttggatcgtaggcgccaaagtaaacttcttcgacacgagccagcatcattgcaccactacacataggacaaggctccaatgtaacaaatagctgcgcttgttctaagcgccagctttcgatggcttggcaggcttgttggatggcaaacatttcggcatgagctgttgcctcttgctgtttttcccgcaagttgtgtcctcggccaataatttgcccctctaagacgacaactgccccgatggggacttcggcgattgcttccgctttttgcgcttctttcagtgcttcacgcataaaatattctttttcactttgtgtgagggtactttctttcttcaaaatgattcctttcaattctcaattgggataaacatggaaagctgacactgactctatagaaaagctctggcaattttttaacgcagtcattcagtagccgtacctgttccagttgctatggctcccaattcctattttccttttctctgaacaaaaaagaagcgccaaatgaagcctagtcaaacaactgctatggcaggacaaccactggcaggttctttcaacgatcttctggccgcttctaacagcattttctccaaggagatattagcttaaaagactgcatcaataaagctagttaacttgtctttgacattctctgttgcatctttgacgttatctccataaaccgagactttatgacggctgtctttgactttcttcatgacgccgagcaatgcatctaaatctttatccgtcaaatcatcgacgacacctaataatttttcgttgccattaaatttgtcgtcaacaaactttttcactttgtgacggttgcaagcgaagcgtactttgttcacgactttgtctgagacaacgactgctgttgagatgccagcaattgccgcaatacttaatccaatcgttacttttgttgatgttttcatatcgatcagctccctttatttgctacttctatgatagcacgaccgatcaaataaaaatactatttcgtttattccagagtgaaccgcaatcctttcgggaagaagtttttcaccacaccttgcacttgtttgccgaagccaatcgggacctcagccaccttcaagacgacccagccttcatttccaggtaccgtaatcgtttcaccagccacgtacttctgccactgagctaactcaattgacaagaaaggtgcttcatcattttctttgatcgccattgccaatgcaaaactcggttcgatacgattctttttcacagtccctacgtgaagccctggacgtaatacgcgaaccccttttagtgatggtaattcactaggtactaaccacagatgatccccaaaaagctggatatcggcagcagtctcttttaaaaatggatagttttcttggaaagattgccaaagtgatcgcgtgacagaatcaatcccagaagcttttttggtttttttggttttctttggtttggctatgttctccgatccaagataggtcagctttgcggcaaaatgaccttccccttgatttttgtgaggccataaccgaatcgtcttttcaatgtcgttcatcggtgcccaatcgtggcgtccatgagacacattttccaattcaatcggttcaatggaaaaaggatatgctgagaccagccattcaatgatggcttcattttcttcaggtgcaaacgtgcaagtagagtagatcaactgtccgccaggctttaacatcgcaaccgcttcagccaaaatctccttctggcgctgagcgcactgcagtggcgaatcagcttgccattccgcgatggccacaggatctttgcggaacattccttctcctgagcaaggagcatccaccacgattttgtcaaaaaattgtggaaaatgcggcgtcagttcttgcggcgcatggttcgtcaccaccacattactgatcccccatcgttcaacgttttccgataagatttttgcgcgtttagtaaaaatctcattggaaaccaataaacctttgccttgcatctgacttgctaattgcgtggttttccctccaggcgctgcacaaagatcgagcactttttctcctggttgtgcatctgcgatcgtcgcaacgatcatcgcgcttggttcctgactgtagacataccccgcttgatgaagcagtgatttccctttgacttctccaatataggcgttcattgcgtatggtgctggacttttatccggtccaaacatttccagcatcgagacggcttgtggcttcaacggattcaagcgaaatccttttactggatgccctgtttctaaagcagtaaaaaaggccgccgcttcggctcctagtaactgctgatatttggtaatgaatgctgctggtaatttcaagatgatccctcctaagctctcttatcatagcgagtgctcagcgattgtgcaagtagcgtcaggcaattttgaaaaaaatgtgacaaaaatcaacagaaggaaatcaaacctaaaataggtcagcaaaggatcgttcgttcgaaaacgatttacgctatccattgcccattcactgctgattttgtcacagtctttcgttattgctgtaggtatcgttgaaatcgatcaatagcatatctacagtgtttttttgtactgctggtatctatcatctgctacttatcattgttgtttcgataggtccgcgctcatttaaataaagatttcttgatggtcttttcgatgaacggcactgaggcgtaatcatcccagaacttgatcagcggaccaactagaaaggcactgataaatgtcccaatcccgatcggtccacctgtgatccagccgagtgtcgcaaaagccacatcttggatcactctgacgacccgataattcgctttcgttcgatcaacgattgtcggtgcgatcgcatcataaggcgcacttcccacttttgctgacatatagaaggaagcaccaaaggtaaagaacagaataccgatcactaaaaagagccctttttgcagccaaccttccggagaaactgcgaaaagttcaaagattttcgtataaaaatcaataaaaaagcccgtcaagaccatattgatcactgtgccgatcccaatatgccgacgaccaaaaaagaaaatcaagatcaacaaaacgagattgatcattaattgataaacacctaatgaaagacctaaccgttcacctgttccaatattggcagctgtatacggatccagcccgacgccacctacgcgaagcaaggaggcgccaaaaccgatgatagctaccccgatcaacgcaaaaagcgaccgcagccatgtttcttttttcatttattccccacctttttctttttattataacgacaatttcaaaaaaaggaaacttgagcattctcaagtctccttcttttcattagtcgcggcgattgttattgccgaataaaataatcaaacgtagtaattgcagcaatgtcgcaactgcagctgccacataagtcaaggctgcagcaaacaatactttacgggcctgcggtacttcttcttccgttaagagaccgccatcggctaaaatccgtaacgctcgtcttgaagcatcaaattcgactggcaacgtcaccaattggaaaataaatgctaacgagaatgctaatatccccagattgattaggaaggaccctctcaaaagaaccccgatcaaaatcaacgggatcgacaccgcggaaccaatattagctactgggacgatcgcatgccggatacgcaatgggagataccctttagcatcttgcacagcatgcccgcattcatgggctgccactccgattgctgccacagaagttgattgtgcagttgcttgagatagacttagcatcttgttgccggaattataattatcagtcaaatctcctgcgatagcttggacgccgacattgttgatgccttggctttccaaaatatactgagccgccttggtcccggtgatattgtttctactgcttattttatcgtatttgctaaacgtgcttttaacgtatgctgaagccgccatcgagatcaccatcccgataatgaccaaaatgaatgttggatcataaaaccaaccaaaaccgtatccaccgattccatacacgatgaaatccctccctttcgtctttgaccttattttaccattaaatggatgaaaatattatgaagaggtatggaagattctgtttttaaagtttttttacaaattctgacttcaatttcatggcaccgaaaccatcgactttacagtcgatattgtgatccccttctaccagacgaatgtttttgactttggttccttgtttgatggcaccagaagcacctttgactttcaaatctttgatgaccgtcacggcatcgccatcctgaagaacatttccgttggcatctttgacgacagcagcagtttcttctgtttcctgccattcattgccacattcagggcagacaaacaagccgcgatcctcatatgcataggcggattgacaaactggacaatttggaatttgagacatattcttactcctcatagtgatgtattctgtgtttattcaacgatcgagcacgatcgtgaaaaaataaatataactgtagcatacaaaatttctgactatcctgcaatatcctgcacaaaaaaatgcaatcgatagaacaaactaagttctatcgattgcatttgatgatcttctcagttctagctaaagatggcttctaagaataaggcttccataagaactgtcgcctaaatgattctatgaacaggataattccgtcgcaagaccaccctcagtctaaaaatagattttcgtctaaaatacgcccttcagaaacaaaaatcgcatccccaatcagttggagctcctctgatgcaacttcgactcgcagctctccgcctaaaacatgcagcacaagattggcttgcgtttgttcccggcgtcgcgccaccgcataagcagttgccccagagccggtcccacaagcatacgtaaagccctcgactccccgttcataggtgcggacaacgagctccccagctgaatcggcatcgtagaaattcacattggcgcctttaggaaatgctgaccaatagcgaatccgttgtgctaaatctgtcaatgcatcgagggatgtttcttgcagaccgggatacttcaccaccgcatgagggattcctggatcacctaactcgatataatcaacgacaggaacctctctgtcagcgaaaggttggtcaaacttcgcaacggtggggggatttaacgtcactttgtactgttgccgatccaatcgccaagcaggaacaggtcctgcaacggtctcgatcaccattgcttctgaagcaaccttattttcataagcatagcgagcgatacagcgtgcaccattgccacacatttccgcttccgtaccatccgcattataaaaacgcatgcggaaatctcccgttccttcgggatgatcgacagccatcaacgcatctgcgccgattgaaaatttccgctgacaaacttgagccgctaacttagccaactgtttcgaagaaaaattatagcgacgattgtcgatcacaataaaatcatttccggcaccttgcatcttggtataaacgatttccatgatttcacctgcttttttttattctttcatcaaaaacgaagggatacgttcattttgaatcaactgctggaaagtctgacgttcaaccaccaattccgcgtgccccttttcaacaaaaactaccgctggaatcgcaagtttattgtaattgctagccattgaataaccatatgctcccgtcgcaaaagtcgcaaaaagatctcccgtctctactttgggtaattgcagatctttgactaagatatccgtgctttcacaagccttgccagaaatcgtaactgtctctgtggcagcttctgctgcccgattggctagaatccccgtatattcagcttgataaagaccgggacgaatgttatctgtcatgccgccatcaatactggcataggttcgaatctgtggcaatgtcttgatcgtaccaatagtatgcagactgatacctgcttccgctacaatactacgcccaggctcgatcaccacagtcggacgttggagctgatgcgcttggcaaaacgtttcaatcgtcgccatcaccgggtccaaaaagtaagaatagggttgacgaatatccttttccgtatagcggacaccaaatccgccgccaacattcaactctttaacagtatagtcaaatcgatgatggatttctagaactaatgctagcgcagcctctgtcgcagcaatatgggaatgattgtcagacaattgacttccgatgtggaaatgcaacccataaaaatcgatttccggtgcgtcaatcacttcttcaatcaaaggaaataaaatctcttcatccaatgggatcccaaatttcgaatctttctgtccagttgaaataaacgcatgggtctggacattcacttctggtgtgattcggaacatcacttttgctttccgctgtttctcttgacatagcgctcgaatcaaaccgatctcctgactgccatcgacaatgatccgacctacaccataatcgatcgctaatgccaattcatcaatagatttattgttgccattgaattcgatttgttccgctggaaatcctgcttggatggctgtgtatagttcaccgccactaacaacatccaaagacaggccttcctcatcaatcaaccgcagcatggctagtgtattgaaggctttcgaagcataggcagctcgggtgttttcatagcgagacagaaattcctcgcgaatagcacgacattgagtgcgaatctcggtcaccgaaaaaacgtacaagggtgtgccaaattcttttgctaatgccactgtatcgcatccatcccaaaacaggtgattgtctttaatctctttgatcattactgcgctcctctcttagtacctgactctgattcaatctttcaatcaatcgcaggtagcactcaatgcctcctaataagactttctcatcaaaattcatcttgctgctgtgcagcggataggtataccctttttcttcatcccgagtcccgacaaagaaaaagacaccagggatctctttttggtacatggagaaatcttccgctaacatgtacggcggtgtctcgatataactgtcgccagcaacatcccgaacagcatctaccatgtctggatcattgtctaccacccgatacaagtgttcgaaagaaacttctgctgaacagccataccctttagcaatctcttcagccgccaattttactcgttgcgtcaatgtttcatagaccccatcttcaaaagcccgcatcgttccgttcaacacgacttctccgggaataatattttctgcatctcctccgcgaatcttgccgaatgtaatgacggccgaagacaatggactaatgttgcgagaaacgattgcatggagaccttgaatgaccgcagctgccgctaagatcgcatcgctgccttgatgaggttgggccccgtgagcactttctcccaggactcgaatcgtgatctcgccatttcgagccatcattggtcccttgcggcaagcaatcacaccttcaggatagtctggaaaaacatgcagaccgataatctgatcaatcgcaaaatcggttaagattccttcatcaatcattagctgcgcaccaccagggccttcttctgctggctgaaaaatcaacacaatggtcccgcgaacagcttccgggtaatcggataagtactttgcaaaacctaaaagcgtcgccatatgtccatcatgtccacaagcatgcattttgccgagatgttgcgaggcaaaaggagcattcgtttcttccttgataggcaatgcatcgatatccgtgcggaatgctaacgtcttccctggtttttcactgcgaaaaacagcgatcaatccggtatccagaaccggataaatttctttgatcccgaaagactgcaactgtttaagcaaatattccttcgttttgaattcttctaatcctaactcgggaatcttatgtagttcccgtcgaaaacgaaccacgtcttcggttaatttcattactgcttgagataattgcattcgtgggcacctttctttcatttgatcagcaatatcggctgaaaatgtatggatatccacatttccattgatattggataatattatagtatataattcgaataatctatagtataaataatcaaaattttttgatttttagtacaattagagaaagaataaaaaggttgaaaggatgtggagtagtttgacgatttttaaaggttctggcgttgcattgatcaccccgatgtttcatgatggttcggtggatttcgacaagttgaagtcactggttgagtggcatatccagcaaggtagcgatgcattgatcgcttgtggaacgaccggtgaagcctcaacattgaacgatgaagaacacattgctgttatcgaggcggttgtcaagcaggctgcgggccgcattcctgtgatcggtggcactggttcaaacaatacgcaacatgggatccatctttcccaagaagcagagcgtgtcggtgccgacgcattattggttgtaaccccttattacaacaaagcaacaaaaaagagtttggttactcattacaaggcaatttgtcaaagcgttgaactgcctgtcatcttatattcggtcgcatcaagaacaggaatgaacttgacttacgacatggttgctgaattaaaagagattccgaatgtcaaaggaatcaaagaggccagtggagatatctcacaaattgcgtctatcgcgcaactagtggatgatgaattttctctctattccggcaatgatgatcaagtcacaccaatcttagcattaggcggttctggtgtgatttcgacgatcggtaatattgcccctaaacaaacagcgactttggtggcagattttctttctggaaatattcaagcagcgattcaggagcagttacgacaaaaacctttgatcgatgcgatttttagtgaagtcaatccagtgcccatcaaagcggcagtttccttattaggaaagtctgacttgcactatcggttgccattaggaccgcctgagaaagaaacaatcaaccgtctaaaaaaagaaatgtccgcttatgggcttttataaggaggcaatcaagtgagacatattttattgagcggtgccaatggtcgaatgggaaaagttttgcagcacatgattgctggacatgctgaatttgtgatcagtgctggattagaccgtcacacggaagcaactggcgactttccaatctattctgcaccagaagcagtcaaagaacctgttgatttggtgatcgatttttcacatcatagcaatgtagcaggcctccttgacttctgtgttgccaaccaactgcccatcgttgtggctacgactggtttaagtcaagcaacccaagaaaaaatggtcgccgctgctcaaaagattcctgttttttattctgcgaatatgtccgtggggatcaatgtattgatcaaagccctaaaagcgatcaccccacctttggaagcagatttcgatattgaaatcattgaaaaacatcacaatcaaaaaatcgatgcgccaagcggaactgcattgttactggcagacagcatcaatgaaagttgtcaagaaccaaaagaatatctttatggccgttctggcaacgatctgaccaatgatcgaaaacaattaggtattcacgctgttcgcggtggcacgatcccgggcgaacacacggtgatctatgcaggagcagacgagatcattgagctgaaacataccgcattatcacgggatatttttgccaatggtgcgttgaaggctgccgaatatcttgcacaacaacctgctggactatatgacatggaaaatctacttgacaagtaaaggtggtaacgtatgactgaattacaattttctgatccttatcaattagccaaatacatcaaagaagccaataagcagaccccagtcaaagtctatttgaatggtgatctatctacctgttcttccgagacactgaaaatttttggggctggctccttttactttattgttggagacagtcaagaagtagctgattttctaacggccaatcaagataaaatcactgatttctatttagaaaatgaccgtcggaattctgcgatccctctgttggacttaacaacagtcgatgctcggatcgaaccaggggctttcattcgtgatcaagcaatcattgagaagaatgcggtcatcatgatgggagcggtcatcaatattggtgccgttgtcggcgaagaaacaatgatcgatatgggggcgattttaggcgcccgggctactgtcggtaaaaaagcccatatcggagctggggctgttttagctggtgtcttagagccaccttcagctagcccagtgattatcgaagatcatgtgttgatcggcgccaatgccgtagtccttgaaggtgttcgtgtcggtgaaggtgctgtggttgctgctggatctgtagtcacagaagatgtaccggcaggggctgtagttgctggttccccggctaaagtcatcaagatgaaagatgaaaagacggctagtaaaaccgagtttcttgacgacttgcggggctgatctcgcctgttgcaacttgcaaaaaagcgtatgacccgcgagtcatacgctttttttatttgcgtaattttttactacagttatttactacaatcaaaaactcaccgatcattcccctagcaagtcctaagattcctcgctgttggttttttcttctgcaaaagaacactgatcacgacgaataaagtctatgcttgttctcgaaaagctgaaactgcggtctggatttcttgatagatggctgccacttcttccagatccgctgcattcgctccgctggcaagcggatgtccgccaccatgatgacgtttggcgatctcattgatcacaggtcctttcgaacgcatccggacccgataatagccttctggctgctcaacaaaaattgcccatgctaagacatcttcaatcttccctggtaaggacacgatagcagatgtttctgaatcaacaacgccaaaacgctgttgaatctcatttgtcagaatcactttgccagctcctagtgaatcaacttctaaattttcaaagacatagccggaaagacgagccactgctctcgaaacctgatcaatctcacgattgatttttggtgcatcaaaaccataatccaacaaatcagctgcgtaacgcaatgtcgcggaggtcgttgctgggtacaggaaacgacccgtatcccctacgattccggcataaagcaggcgcgcagcttcttgcgacatagtaagttcttcagcgaacattttccagaatgccgtaatcatttcactgcagctgctagcagtagtatccacccagaccaaatctccataaggttcgtcattaggatggtgatcgattttgatcaattttgcaccattggcatagcgctgatcactgactcttggtgaattggcggtatcggtcacgatcactaaggcatttttgtagacttcatccgaaatctcctgcatttctgctaagtagtctagcccttcaacaggccctcccacttgatagatcgctttttcaggaaaactagctcgtaaaatttctgccaatccaacttgtgaccctagtgcatccggatcaggtcgctgatggcggtgaataataattgtctgatattccttaattgctgtcaatatttcctcttgtacgttcattgcatatctccattttctaagcatttatctgatgactgctgttcgaattaagggcgctccattacttggcagacgacaattgctttagctaccatggaattttcgatatagacttcaatatcgatcttagcagatcggcgccccagctccaaaattttgggctgaataatgatctcactttctaattggatcaagcggaaatagtgtagattcacttgttcgatccagctgtttcgccgctgattgacttgcatcgttcgtttggcagcattggcgatcacttcactgagcacaccaaaagaaatcgttcctacttcattgaccatttgtggagtcacagcgaaacgaaagtttggctgtgccaatttattgccttcaaaatcttgttcaatgatttggatctgaccagaaatctgatcagagatcgtatcggaaatctgggtctgtctttggactagttgcatcgccttcataatgtcttgccgagtcacgattccgatcaaagataagtcatctgctactactggcatcacttccaagccatcccaaatcatttgatgactggcagaagcaacactcatctcttttttcacgactcgcggttcacgagtcatgattcgttcaatgatttgcgtatcgggtttttccaaaacatcttttgccgtaatgatcccaaccacgcgcatgttcttgttaactaccggatagcgagaatgattggtttcttctgaaagacgtttatagtctttgacagtgtcaaacgtatgcagatactttgttttttccagcggcatatagatatcgctaacgagcataatatcttttttgatcagctggtcactcaatgcccggttgatcatcgttgcaacggtaaacgtatcataagtcgtctgcaatattggcagttccagcttatcggccaaacgacagttttcttctgatgtttcaaacccaccagtgatcaagacagcagcaccatcttctaatgctaattggtgaacttcatttcgattccctacgatcacgagcgatcccggggtgatatatcgttccattgctgattctttcatcgcaccgataacaaacttattcaagtccttatctagaccggctgcgcctcctagaacctctccttcaatgatttgtacgacttctccaaaggtcaatttttcaatatgtttttttaacttacgctcgatcctaatggttcctacccgttgaatggtagagaccagaccgatattttctgcatctttgattgcccgataggcggttccttcactgacacctaaatcctttgcgattccccgtactgaaatacggtctcctaccggcaaactttcgatatgcgctaaaatcaagtcatgtttcgtcgccataattttctcctagttaataaaatccgtcaatcagacggtcaacaatcaatcgattctcccacagccaaaacggtgcctactccctcaggcagcaagtcgataaaagcggcgggatcttgtttgatcagtgggaatgtgttgtagtgaactggtacaactttttttgctttcaataagtgggcagctgcggctgcatctttaggtcccatagtgaagttatcaccaatcggcaagaaagccacatcgatcgcaaattgttcgccaatcagtgccatatcaccaaagagggctgtatcccccgcgtgatatattgttttgccttccgcttctaaaatgattcccgctgggtttcccatatagatcatcttgccgtcttcttccagaccggaactgtgctgagcttgaacgaaccgtaccttgccaaagggaaaagtatatgagccgccgatattcataccgtgagtcttcgttactcccttacttgttgcatactgacaaacttccactacactgataataggtgcttctgtacgtttggcaatcgccaccatatctcctacatggtcgctgtgcccatgagtgatcagcagccagtctggatcaactgtttctgcatccagatcagtcatagcgtttccatttataaaagggtcaaacaacaacttttgtccatcttccaactcgatcgaaagaaccgcgtgtccatgaaaagtaatcttcacaacaattacccctttcctattcataagtaatacagactaatattttctattataacagactaatacaaaattccaaacaatcaattcggtgtatccatttcattcatgacgttattcttctcttagtcaagaaatcacaaaaaaactgttctagtcttcagaaaaaagaactagaacagtttttttaggttcgcagcttacagagaatgtttctggaagccaccttgttttttgatacgccacatagtcatcaatagggccacagcacataaaagaaacgcaccgaagaaagtaactttcattccataattgaagatatctggtcgtccattgatatatgtcgtcacatgctgaccataggcactgctcatcgcagaatatagaatcgttgtggacattgcaatccctagcaccatgcctagattacgagcaaaagagttcaagctaccggccactcccaaattttctttggtcacgctgctcatgaccatggtattattcggcgattggaacaaggaatttcctaatcccatgattgctgtagccaccacataataccaaataggtgtatgctggttcataaacatgtacatcagttgggtaatcgatagtaaggccaagccaatcaacaccaagatttctggaccgacttggtctgtcaaataaccgctgataggcgatccgataaccatcatcaaaggaaagaccatcatcaacattccggctacacttggagtcaacccacgggcattttgcagataaaatggaatcacgacattaacaaaaaaattagcagaaaagatcagaagtgccgtaaacaaacttaacgtaaaaattttatttcggaaaatgctgaaagtaatcagcggcatcgccacccgtttttctacttgaataaaagcaataaaagcaatgattgcaacgaaaatcaatactaatggcaaccatgtcaagaagccttgctcctgaccaatgaaaattccaccgaaaaaggtcaagatcgccacagagaatagaccaaatccacttttatcgatggagttgcggctcatggtgatatctttgggtaaaattttctccccggcaatcatagtcagaattccgacaggaacattgatccaaaaaatataaggccatgaaaaatgagacaatatgatcccgcctagtcctggaccagcaattgatcctagcgacacgaaagcgccgatcatccccagtgcccgtcctcgctcactaataggaaatacttccgtaatgattccagtatttgttgccatcgtcatacttgcaccgatcgcttggacgactcgtgcaaagagcaaaaaagccaacgaatggttgaacccgcacaataaagaaccgatggtaaaaatcaacatgccgagacgaaagaccttgattttcccccaactatcgccaatcttaccaaatagcaacaaacaagcacaaaccaccatcaaataaaccgacacgacccattccgcttggttcatgggtacggacatatttgccgatatcgtcggcaacgcaatattcacgatgctgccgtctaatgtagacataaacgtgaacatcgcaacagcaatcaagatccaccattttctctgctggacaagcgtatcttcttgataacttttcactcaaaaccatcctttcgatccaatcaattttcttttaacacgagtttcttcgtggaattgttttttatccagacatcactccagcattcggacaagtcaaattagccagactaacaaaaataactgacacgccttgagagaccccaccaatccgcaccggaaaacaggagcaatttcaatgtttggttattggaacacttgctttagacaacaccctgtcaatgaagacctagatattatcgatcggacaatgttctcgtatttctgcgctatgtatctaaagagacaccacaaaaatcaaagcaaaaactaggacgtttgtagctggcgtcctagttttctggatgttttatttgcgtgatcgatttctttgactggattccatgatcacaggcaagatcactggtcggcgttttgtctgttcaaacaagaagcggcttaagcgatctcgaatgtcttgtttcaatttactccattcaaactcttcatcatgcaaatgtttttcaacgatctctgcaacgatctcaccactttcccgaatcaaatcacgacttgctttgacataaacaaagccgcgggaagtgatttgcggtgctgcaatgattttcttttcgcgacggttgatcgttacgactgcgacgaaaataccgtcttcagataagactttacgatcgcgtaaaacaatattgccgatatcaccgacaccgatcccatcgatcatgacattctcagctggtacagcaccagctgaatgcatttcgccttttttgtattctaaaacatccccgcgtgcggtaatgaaaatattcttcaacggaatgcccacttcatgagccaagtccacatgtgctgccaactgacgatattctccttggattggtaggaaatacgttggcttcattaaattcagcatcaattgcagatcattcggattcgcatgaccggaaacacgaaaattatctgaaatttgcttcacggttccacccgctcggtaaatgatatcttccgttttggcaacgaccgtttccatagctgtcgtaggcgtcgtcgtaatataaacgagatccccttcttgaatccgtaatgtacgatgtgttccgttcgccattttctgcaatgctttgatcggttcacccatacggccagtctctagaataagcaattgctcattggcatactttttcatttctttttgggtgatcagcaaatcctctgctggtaattttagtttacccaacttcatcgcagtgcggatgatccgtccaaagtcctgaccagtcaaaactacttttcgtccggaacgatatgctgcatccagcacttgttgaaccctctgcagattgctggctacacttgcgacaatgatccgaccttcccaatagcgaatgttgtcaaacacttcatcttgaatcgtcaattcagaagcaatcggtgctgggttttctgcatttgttgaggtgctcagcaatgccagaacgccttctttaccgatctctgccaaacgtccgaaatccgtttgatacattgggatagctgtttgatcaaatttgaaatcccctgtatagacgatatttccagcgctggttttgacgctgattccgacagaatcaggaatcgaatgcgttgtccggaaaaagctgatggttgcatgaccaaaatcgatttctgaatgttcatcaatgatatggaaatctttgaatttctttgttgcttcgttttttgctacggtcaattttgccaattcgatcgttagctctgttccaaacaccggaactggaacattctccaagaaatagggcagcgccccaatggcgtcggcatgtccatgagtcaaaaagacccccgctacgcgatctgcgttttcttctagatacgtgaaatcaggaatgaccgtatcgattcccaataactcgttttctggataacggacaccgcaatccagaacaaatatatcctctccaacttcagcaatgtacatattttttccgttttcacgtacaccaccgagaggaatgattttgatagtttccaatctattcacctcttgatttttttacactatttatttccctagcctaagccgtctctttcattatacaacaaaaaaaagaaaagcgtggcattcgctacacttttctgaaaaacttatgatttacactcgaactagagactgttcatgcagcgattctgcgatttggatagagttccaggcagcacctttcagcaagttgtccgctaccacccaaaggtgcagaccattcgctacatctaaatcttttcgaatccgaccgacgaaggtctctgtcttaccgacactcgtcagtgcttgtggataaatctgctgacttggatcgtcttgcagaactgctccgggagctgctttgatccactctttgactgcagtcaattccgcaggttgttttgtttcgatataaatagattctgagtgcccgctaaagactgggatccgaacacaagtagccgctacttggatcgctgagtcttccatgatctttttggtttcattaatcattttccactcttcataggtgtaatcatcttccgcaaaaacatcgatctgcggcaaggcattgaatgcgatgggatagtgtttcttgtcaccgcccgctggcatgatctctggtgccaactgatcagctggtgttcctgacaagtaagcttgagattcccgtgtcaattctgccattgccttagcaccggcacctgaaacagcttgatacgtcgaaacaatgatccgcgataaacctgcgtgttgccgaatcggttctaatgccaccatcatctgaatcgttgaacaatttgggtttgcgataatcccttggtgttttgctaaagcatgagcatttacttcgggaaccactaaagggacattcggatccattcggaagtagctcgtattgtcgattacgaccgcaccgcttttaaccgcttctggggcaaattgcttggagatactgccgccagcactaaataaagccaaatctactccaataaatgaggtcgtagttaattcttgaatgaccaaagtggctcctttgaagacacaggttttcccagctgatcgctttgaagccaatagaatcaattccttgatcggcaatgtagtcttttctaacatctcaatcatttttgttccaactgcgccagtcgcaccaacaacagctacccggtaccctctatccatttgatcactcctcgaataaaaatacatttttactagtttatcatatttaagcaaaaagaaaagaccttacataagcattctcagaaagaaaaagaaaaaatctgaaaattccctcttctttcgctttttttcaaaaaagggttatttttcgactgttattatttgtcacatctacgggttataggctataatattagtagaaagaattttggggaagattctttccaacgtgcatggggaaataaaacccaatcagcctaaatgaggcaagacctgttttaacagatcttgcctcattttattttttaattattgctgatttcattgttgatttttgcaatgacaaatcctttattatcaatgatcattgtctcatcttcgatctgcataaactgatctaataaaatttcctctgggcaagacaatgtgagttggtcttccccggtattaaagattccaatgattcgttgcgcacctaattcccgctcaaaaatgatcaatccttcttcttcagaaatcacgttccaattcaaagagccctctgaaaggattttttgatgactcttgcgcaaatgaatcaaatcagttgtgaagcgcaacaaatcgcggtcttgtttttcttcttcccaaaccatacatttccggcaatccggatccatatccccggtcaagccgatttcatcgccataatacaggcagggaaccccttgctgcaagtaggtaaaagccatcacctgccgcatcaggtccttatcgcctcgtgccaatgtcaatagacgcggcgtatcgtgagaatccaaaatattgaattggacttgatttgtctggtcccgataaagcatcaattgattatttagttccgagaccatctttgtcattgatatttcgcctttgacgaagtattcaatgattgcatccgtaaaagcatagttcatgactgcatggaattcgtccccttggagccatctttgagaagaatgccatatctctcctaaaatataaaaatcgtctttggcttcatcacagacctgacgaaatttcttccagaaattatggctcacctcattggctacatccaagcgccaagcatcgatatcaaattcttcgatccagtaacgagcaattttcaggagatagtcttgaacatccggattctctgtattcagcttcggcatatgcggggtaaatgcaaacacatcatacgtgatatcataagcatcttcaaaatcttcgccttctttataattgacagggaattcattgatatggaaccaatcggcaaagggagaatctgcaccattcttaatgacatcgagccattggtgggaagtatctcctatgtgattgaaaactgcgtcaagcatgaccttgattcctcgtttatgacattcctccaccaaccgtttaaaggtctcgttatccccaaatgccggatcaatcgctaaatagtcgatggtatcgtatttgtggttggagtaggcttcaaaaatcggacagaaatatatcccattgatccctagcgaaacgagataatccagatggtcgatcacaccttgtaaatctccaccaaaaaaatcttgccgatcaggatttttggacccccagggcaatgtgccttcaggatcattcgatggatcgccattggcaaagcgctccggaaaaatttgataccagacggtttctttgacccattccggcactttgaaccgatccgcttcttgaaagtaaggcatccggaaataattgttgttcatttctaagtattgctcttcaaaaggatagaccccatgatccccataaaaaacatggagaccgtcaaaactttcaattgagaagccgtaagacaatcggcgaaattctgcacttacagtcacttgccaataatcatgcaagtccgtagacaagattttatccatttcgatccttcgttggtaccaagcttctttgtataaggtatacggatccccgcataataattgcacgtgacgcacatcttgacgagctgtgcgcagccgaatgtgcattttgtctttttcaaataaataagcaaattcactttctggacgatgataaatagcagtagtattcatagcagactcctttaattatttgttgcctctattttcccacacacaagaagagaatacaagcaaaatatgcaatcgattgctttatcctcttctttttacaaaagggcgagaaatataatagaaacatcaaataacacaaacgaagcaatcgtttgcattgctataaattggggatcatttacttggtttagaattgttcgagcaagcgtgttcttttaaaatgtcatacttccgcaacaaaccaatcactgtagtcagcgcctgataaagctctgtaaaatccgaagggcgcattgccgaaaccttctcattcaagcgatcctcaatttgttgttttttgcgactaaacaattctcttcccgcttcacacataaagacattgacgctgcgccgattcgtttcattggttttgcgaatgacaaacccagctttttccaatccagcaatcgaacgactaatctggaccttcgatgtgccgatttgtcttgctaattccgacatcgtcatcccttcattagctgcgatgataaccaattcaagtatttccatctttgtcaattttaaatcttcaaacccaacttcttcaaacaaaaggtttcccagtagtgagaaaacttctgcaaatactgatatatcaaacttctctatcgcttttgtcattttctccctcttttcttctctatagtttagtataagaacttctgcaaaacaataacgattgttgatttttgttaactgttatgatagcttttaaacaggatgaaaaaaacatgaaaatggcaagaaaagagtgacagcatgctagaattaaaagatatcaagaagtattataaagtaggatcaagtaccaccaaagcattggacggtgtctcggttgctttccgaaaacaagagtttgtagccattttgggaccaagcggctctggaaaaaccaccatgctaaatgtgatcggtggattagacaactacgactctggagacatggtcattaatggaaaatcgaccaaatctttcaaggaccgtgattgggatgcctatcggaacaattcgatcggttttgtgttccaaagttacaatttaatcagtcatttggggattattgataacgttgagctaggaatgacactaagcggtgtttcaaaagaagtcaaacgagcgaaagccgaagatgcgctgacacgggttggtcttgcggaccatatgcacaaaaagccaaatcaactttctggtgggcaaatgcagcgggtagcgattgcccgagcattagccaacgacccagatattctgctttgtgatgaaccgacgggtgcgttggattcagagactagcgtccaaatcatgaagctgatccaagagctttccaatgaaaagctcgtaatcatggttacccataacccggaactagcgaatcagtatgcggatcgaatcattgagttcaaggatggtcgaatcttaaaagattctaacccgcatattgaagaacaaaagaaagatcaatttgaattaaagcacacgaagatgagtttcctcactgcattgcgtctttctttcaataatatccggacaaaaaaaggcagaactttcttaacggcatttgcttcaagcattgggatcatcggcattgccatcgtcttgtctttatcgaccggattccaaaagcaaatcgataatacacagtctgaaacattggcccgtttcccgatcacgatctctaaagtaacgacggaacaagacccttctgcaatcagtactcgtactaaagaagagaatttcccgtccactaaagaagtgaccgcaaaactgagtgacgctgaccgggcaacccatatcaataatattgatcaggactttcttgactatctcaataaaattgatcctgagttaagcaacaacattggctacactcgttcgacttcgttgaacttactgcgtaaggtcgatgataaagtagaacaagtcagcttttcaaatgcttcagctgataacgagcagacaaatgccatgatgtccgcaatgagtgcttcgacgggaatcggcgtttcaaccttcccagaacaactatctgaggaaaacggcaacttcctgaaagacaactatgatttgctgcagggagaatatcctgcatcagcaaatgacgttgtactgatcgttgacgagaacaacgtgacgaacgtcaacgcattgatcaacttaggatttgatatcaaagacggcgataaagtgtctttcgatgatatcgtaggaacaacagtcaagttggcacttaacgatgccttttatactgaattgccaactgggaactttatcccaaatcaagatttaacagctgtttatgacaacagtgcaaataaagaattaaaaatcagcgggattttacgtatcaaagaaaaatctacgatgaatttgctttctaccgggatcgcttatagcgatgcattagcccaagaagttatcaaagaaaacaaaaactcggcaatcgtcaaagcccaaaaagacagtgatatcaatgttatgaccaacgaaaaaatcgatgctagcacgcgcgattctctaatcgattacttaggtggcagcgacttgccaaacagtattatgatctatccaaatgattttagttccaaagaaaaaatcttggactatcttgatgcttacaacaaaggcaaagatcgtaaagatcaaatcgtttattctgatttagctggaaccatgacgcaattgaccggcggcttgatggatgccatcacttatgttctgattgcttttgccgctatctcattagtgacgagcatgattatgatcggtatcatcacctatacttcagttttggaacgtacgaaagaaatcggcgtcctaaaagctttaggtgcgcgtaaaaaagatatcactcgtgtcttcgatgctgaaacatgtatccttgggattgcttctggtgcattaggtgtcttgattgcttggttagctactttcccaatcaacgcggtcttatacaatatgactgatctggaaaatgttgcacaactgaatccagtccatggattgatcttaattctggtcagcacgatcctaaccatgatcggcggccatatcccagcacggatggcagcaaaaaaagatgctgcgatcgctttgcgggcagattaattctttctaactagtcacagctaaagagagcattgcagctgtcagttaatggtgctctcagcaaaacaaaaagtactcgaaaagtcattttcgagtactttttgttttatgcctgcgataagctcttttgtaacctgaaaatccgggttatagaggactgctcctttgagtttgtggatggtctgcttccactaaaagaaagcattcagctagagcagccagcacttatcttctattctctttaactctctttaatcttagtcaatgatttctccattactgcggataactctttgataccaagcaaagctatcttttttgattctttcgccactgccttttccataatcatcactatctacataaataaatccatagcgtttgctcatttcactagacgaacagctgactatatcaatgggtccccaagcatagtaaccgcgcagatccacaccatctttgattgcttctttcatggctcgaatatgatctcgataatactctatacgataggaatcatgaatgctcccattttccaatttatcaaaatagccaatcccattttcagtgatataaattggacactgatagcgatcataaaactcatttaaaagaattctcaagccaatgggatcaattgtccacccccaaggatttgctggtagttccttatttctgtgtggtcctaaatccttatcgtaagagtcttgatcgcatatttgtgtatagtagtaagaaaaagacataaagtctgccgtatgcttcagtgcttcttcgtcatcttctccaaaagttacatgaatgcctttatcatcaaagtaacggaaagcataaccaggatagcggccgcgaagtaagacgtctgcaaagaaatactccatttgatttaattttaatgcagctagaacatcttccgccttgctagatgcggcataagatggaccgccacaaagcatcatgccgatctcattatctggataatgtgcatgcgcatattttgtaatcaatgcactagcaaccatttcattgtgtactccttgatatttagcagaaagcaaatcctctactgcatcctcaggaattccaagatgattgaacgattcatggacaattaaattgatttgattaaccactatccacttctttactttgtcatgatagcgatctagcagaacttgaccataacggacaaagaaatcaataacttctcttgaataccagcctttatacgaagttgtcaaatgaagtggcatttcatagtgagacattgtgatcattggttccataccattttttattatttcatcaaataaatcgtcataaaactgcaaacccgcttcattcggctccaactcatctccgtttggaaaaattcttgcccagttgatagaagtccgaaatgtttttagccctaattcagcaagcaatttcaagtcatctttatacgtgtgatagaaatcaattccccaccgttttggaaaaattcgctctgtactgttcattgcttctttgatataagctgtcgttatttccatattagatttcttttctaagtcaacatctggaagaaactcattaatatctgccacacaccagccttttccgtctacatcccacgcaccttcagcttgattagctgcaatagcaccgccccataaaaaatcttttggaaaaccttcaggtattttagtcattttcttcctctctttccagtctactctccaattgctcaatgcgccgatcataggctttaaaaattgccagcatgcgtttagcaatatttatctcactgtaaatagtcatcaatgtatcctgtgcatgtgcgaacaacacagaatactctccatcttcaccagatgtttcagccgtaattgcatctgtctgtatgcggtgtgcctgtacaatctcctcatttgcttgctttatttccacttcagccagtgcaaaatcatatgattcaatcgctttcaaggcatccatacaatgctttctggcatctccagcatgtagaattatctgcatggcatgttgaacgatttgttctttcaccattctaagaccttctttcacaattatctttctatactctttcagttgcttcagcagcttctctttcgcattcttgtttttcataggctttaaaaaatggataccaaatcgctgccgccacgacaaaaacaatcagcattagcagaatgcctgaaattgttccggtagttagccaagtggcaatcggaaatggacagtaccacatttgaaacatgactgttggaataggtgcaaaagcaatgactttcgtaaataaccagacaattaatggcaatatcaacccttgtaaccacatcgggaccatcaatagtggattccaagcaatacagccaaaaacaatcggttcattgatattaaaaatcgtcggagcaaccgaagccgtacccaaggcttttaatttttttgatttggagcgcatcaacataaaaacaagaggcattgtacagccgataccgccaatccatagataagcagaataaatagttggatcagttactaaattcattgcctttccgtcaatatttgcttgaatagcagtcaataaaactggatttaaaacaggcgttaatacccatgttgaaattcccaacgaatagaggaaacaaacaatcaacatcatcaatgaaaagccccatggcgtctcaatcacactttgtaatggcataaagatggctagaacagcattgtagacatcaaagccaagaagatcaacgaagatccatccggtaaggacaacaataccgattggcagcatagcatcaaaccaagagcggacaaaatcgggaatcaccgattcctcactgaaaaaagaaaactttccaaataaattcaacaccataccagcgaatagtcctgcaacaattgcaataaacattccccctgcaccaagcgcactatgactaaaaccaggttctccgtcagcaatgacttgtggagaaataataatcaaaaataagatgattccagacattccagcattgattctttgcttacgcagtctttttttctccatcaagttgaaaggaatcagaaaagatatgacaagtgagatcatccccatcgtccatccgtatggcgtccagaaattgggtaaacttggaaaataatcatttaaaattgccagcatacaaaagaccgatcctaagaaaattaatggcaaagcctgcatgattgagtctttaagagtcacgatccaaacgttatgattgattttattcattttgggcgtaaagctgttttccagccagttaattaaggattgcattttattccctccattctgaaagctactgtacctcttccaacaagtgatccaaagcttgttttccgtttaatgtggcatagtattcaggcttcatcaaaatcactttcactggtgcatcaccaacaaattcttctacttcatccaaaatatacgccagatggggaccaaccattaacgcatcaatgtcgtcaatgtagttttcaatctcactttcaccgcgagcagtaatttttatgtccaatcctttttcagcagcagctttgcgaatattagcagccataaaacctgagctggctccagatccacacacaagtaaaacattcaattttttcatgatttttctcccccaattcaattttcattgatagcgctatcaattacagttatactatagtcaatctacagcggtgaaacaaatattcttttgcactgcagtggtgaaagagagggtgtcagccaatgaaagcaaagtatataaaacttcttcactatctaaatgagcaagacaattgggtttcctccactcaattagcggaaaaatttgggttatccaaacggacgataaaatcgtatatcgcagatattcaagacaatgaatctgatttgatcctttcttcaaacaaaggctatcgagtgatagcaagtaatctggtcacttttttcaataacacagaaacaagtgtccctgaaacacctactgaacgaactgcttatctccttttgcgactgatttcaaccgaggaagctctatctgtttatgatctagcagaagaactatttatcagcgagtccacattattgagtgatgcaaaaaaacttaaaaaaaaatgttctgaactggctatcgaagtcagactaaccaaagatacactacagttgattgggacagaaaaagcgaaaagacaattaatccatcagacattgctatccgaattggataatcatttcgttgatatgactaagctacaagaaagttttatagattttgaccttgattatatcaaggaaattattgccgaacttttttcagactatgattttttcacgaatgattatgcgttaacaaatatagttattcatctagcaattgccgtagaccgtatgaaaggaaattttcagtctcctgaagcagaagctcaagcgcctcactcaatccatccgacagtactaaaaatttccgaaaaaatcgcggaaaaagtagcggaacggtacggtattcgttttcccaaagaagaaattcgtgatttagctatcctaatttcagcgaatggaactagcgtgaatttcactcaaatttcacctgatgagttagagaaggtcacggacaaaaactgccttgacttagtaagaaaaattctagcaaaagtggatgaattatactttattgatggcaatgaacctgagttcttcattcgatttgccctccatataaagaatttactgtatcggatcaataacggctactcttgtagaaacccaatgacagaaacactaaaaaaagaatgtccgctcatctatgattgtgccgtccaggtttctcatgtcattcaaaaagaaatcggttatacgattagtgaagacgaaattgcctacatagcttttcatttaggctatgcgttagaaattcaaaaacagcgtacgaataaaataaactgcacgattctagtgcctcattactacaacatgaatattcaggtgatggaaaagcttcagaaaaatttctctgatgaccttgagatccagaatattcttactagtgaaaaagagttgcagtatgtagatacagaactgattgtgtctgctgttaaactgaagcaagtgatcgctaccccatacgtgatcattaatcctttttttacccttgaagatcggcaacaaattaccgccaagatctttgatatcaaagaaaaaaaacgaaaagaacaatttgtgaaaacctttctatcgcttgttgataaaaagcgattctcatatacaactgaaaatcaaaactccgcagaattgctcaaacaattatgtggtcaaatgaaagaagaaggaatcgtggacgagaccttttatccacaagtaattgagagggagcaactttcttctactgcctttggttcagtggctattccacattcactgacaatgaatgccaatcgtacgggggttgcgattgccgtcaatccaaaggggatccagtggggaaataatcgtgtcacattggtttttttgatttccatcaattaccataaccgtcatgtgtttcgggaaatttttgatgatctggccatgatttgtacagatgaacaaaacattcataaattaagtgccataaccaccttcgatgaatttgtagacacgctgacacagtgttttatcagcaacaacacaaaacaatgatactttttattattgatagccatacacgtcgcacaatagtgggcagcctcttggctgttctttgattaataaacttggttattaacattctaaaggctgctcttcttgttcttttgacataataagaatataaaaaagatcctgataaaagttcattcatcctcgacatacaatccagcgtcaagaagcactcaaaatcatcaattttgagtgcttcttgtttttttatgtttcttaagaaaattttcggtctttctaaacaagtgggatcaaatagatttccttcattcatcaattctatgtagagcaacattccctattttagattaggattgatcaatccaacaatcaccaatcaccttggcaaacgaaatctgtccttttctaatatctgtttttttagttaatgcaaactttcagaagtttttctcttgaaaaattcataaacaaggaatacaataagattgtttttaggtacacctaaaaagataggatgtgacagaatgaatgaagaaaaaaaattgatccaggcagcaaatggacctagcttggaagaaataaacaataccgtagctattcccaaggatgggaatttttggcgtaatcttttagctttttctggtcccggagcgttagtcgcggttgggtatatggatcctggtaactggatcacttcaatcgggggtggtgccgaatatggttatctcctgctatccgtcatcttgatttcaagtctgattgcgatgttgctccaatacatggcagctaaactagggattgtcacccatatggacctcgcacaagcaacccgtaaacacaccagtaaaaagctgggctttttcctttggattattaccgagttggcgatcatggcaacagatatcgccgaagtaatcggtggagcaattgctttgaatctattattcggtctaccattagttgtaggggtctttttgacgattttcgatgtctttttactgcttttcttgatgaaattaggctttcgaaaaatcgaagccatcgtaatgaccttaatattggtgattctgcttgtttttgtttacgaagtgattattgcccaacctgatcttccggcacttgttcaaggcttcattccccaaaaacaagtattgaaccctggacagctgaccatggcattagggatcgttggcgcgaccgtcatgccccataatttgtatttgcattcgtcgatttcacaatcaagaaagattgatcggacgaatccgcaagaagtcgctacagctgttcgctttgccacatgggattcaaatattcagctttcggctgcttttgtcgttaattgtctgttgctgattttagggagcgcattgttcttcggtcacagcgaagaagtcggtactttttcagcgctgtatgatgccttacaaaattcagtgatcgcgggagcggtggctagtccagcccttagtgttctttttgccgtagcattactggcttccggacaaaactcaactatcactggaacactgacaggacaagtcgtcatggaaggcttcatccatatgaagattccaacatgggcaagacgattgatcactcgtggcctttctgtcgtacctgttttactatgtaccctctactttggcggtaatgaacaggcactagataatcttttgatctattcacaggtctttttgagtattgcattaccagtctcaatgattccattggtttactttactagttccaaaaaaatcatgggcgaaaagttcaagaaccctctgtgggtcacttctctgggctggatttgcgccatcgcattaacagtcctcaacattcgcttgatcatcgaaacaatgtctggtattttttaaaaaaagaaaaaagccgcacgatcgcagttttctctgcagacgtgcggcttttttctttttagctttctagcttttggtttctaaatcatgtaaaaacagaccacttaacaatttgggttcaaaccatgtagatttaggcggcatgatctcattcgcatcggcaacagccaataaatctttcatctgcgttggatacatcaaaaaggccattgtccattctccggaatccaccatccgttccaattcttctggaccacgaattcctcctacaaaatcgatgcgcttatctgtgcggacatcttcaataccgagtaatggcgctaagatatttttttgcaaaagagaaacatccagactttcgactgcgtcattccctgcttctttgatggttaaagagaaccattcgtggcccaaatacaaatagaaggttcccttttgagaaggcttgctgctagttggcttctcaatgtgaaatttctctgctagatgatcgaagaaatgatctggaatcggtacattgaccactcggttgtattcccagatcgccaattcattttccggaaacaaaatcgctaagaagcgctcgctttcctcactattgtttttttccttgcgcttttgcaagccgactttcactgccgactcggtacgatgatggccgtcagcgatatacaacgcatcaatcgctgagaattcttgtgataaagcagcaatcaccgcagaatcatcgatcagccaaacccgatgatggacctcatggtaactcgtgaaatcatagatcggttgatggtgactctgccaatcctggatcgttttttttaaggactcaggctgacggtaacttagaaagattggactcgtgtttgcatcacaagcttggatgtgattgatgcggtcaacttctttttctggtcgagtaaactcatgttttttgattttaccagctacataatcctcaatcgatgtgcaaacaacaagcccagtttgactccgccccgccattgtcagctcatataaataataggacggtgcattgtcttggatcagccattttttttctcgaaaagcagccaaattttctgctgctttcgcatacacttgcggatcataaggagcaatatttggcagatcgatttctgagcgatcgatatgaaaatagctgtaagggttgccggcagcatatgccgctgcttcttgcgtgttgactacatcatagggcaactccgcaattttctctgctaagtcagtttgtgggcggattgctttaaaaggaaaaacttgaaccattaatagcctacctcctgattcttgatcactcgcacgcgaataatatcttctttagctcgtaatttatctgccaccgcttcaagcaatgcagcatctgttgctccgacatccaccaatgtgtaggcatagtcgtcacgtccgcgattcaacatattatcgatgttgattccagattcagcgatgatcgaggaaatttgtcctagcatatttggcacgttgcggttaatcactgttaaacgatacggcgaatggaacgccatttctacggttggaaaattcactgagcgtttgatcgtcccaaactccaaaaatttcttcaatgtgcgggcagccattttggcacaattgatctcagcctcttctgtcgatgctcctaaatgcggtagaactagcacgttgtcatggcccagtaagcgttcatctgcaaaatcagttgtataaccagcaatctcattattatctaacgcagcaagagctgcagctgtatcaacgatctcactacgagaaaagttaaacagtttagccgttggcttcattttggccaattcattcttgcccactaaatggcgggtgttttccatcaatggcacgtgaagagtaatgaaatcacaggttgtgaaaatttctgctaaatcattggcccgtttgactctgcgggagatggtccacgctgtgtccaccgaaacataaggatcatagcccacaacttccatccctaagcggtaggcatcgttagcgaccatggcaccaatcgagcctaacccaaccacaccaagctttttgccttctagttccgtaccggcgaattgctttttgttggcttctgcctgttcctctacatctgatccgttcagtgtttggacccattgagcaccttggagaatcgggcgaacacttaataacaagcttgcaataaccaactctttgactgcatttgcattagctcctggggtattgaagacgacgatgccttgttctgtacattctttgaccggaatattgttcgtaccagctccagctcgcgcaatccctaatacactttttggaaaaggatagtcatgcagcttttggcttcgcagcaagattccttctggctcatcactttcattgatggcatatttttctttgtttagcctttgaagcccttctggtgcaatcgcattgaatgtcttgatctgatacatttatttgacctccgcttcgaatgatttcatgaaatcgacaagtgcctgaacgccttcgatagggaacgcattgtacaaacttgctcgcataccgcctaccgaacggtgtccttttaagtttttaaagccggctgcttctgcagcttcattaaattgtcgatccagctccttatcgccagtgataaaaggaatgttcgttagggagcggctatttttgtctacgggactgctaaacaagttcgatgcttcgatcgcttgatagagcagtgcagctttttgtcggtcttgcgcagtaatcgctgctacaccgcctaattctttcaaccactcaaaaaccagttttgcgatataaatgctgtaagtaggcggcgtattgtaaagggaaccgttgtcagcttgaagacgatagtccaacattggagcaaagaccgcttcttcatttaataaatcttctcgaataataaccaccgtcaatcctgctggtccaatgttcttttgggcacctgcatagatcataccgaaatcttctacacgatactcattggccaagatatttgatgacatgtcagcaatgatcgggactttgccagcatccggaatcgtctgaaaagctgttccttcaatcgtattattcgtagtaatatgcagataagtcgctgtttggtcgatgttatctactgtgatttctggaatataagtaaaatgcttatcttcacttgatgcgatcacctcaaccgtagcaactgcttcagccgcttgaatcgctttttttgaccaagagcccgtgttgatataaagggcctttttgtttttcgctaaatttaatggcaccatactaaattgcagacttgctccaccttgcaaaaacagcacccgatagttatccgggatcgccatcaattcccgcaagagggcttctgcgtcttgaatgatctcttcaaacaaggaagaccgatgactcagctccataacggacatcccactgccacgataatccaaaagctcggattgagctctttccaatacggggcggggcaagacggcgggaccagctgaaaagttataaacagtcatacaaaaatctctcctttgttgttagatgtgacacccattatagcagaaggaggaatatgaaaaaaggttaaaaataattaaaattctcaattttctgaaaaaaagatgaaagcaattgataacgttcctcaattgctttctaaccattgccagatttcatgaaatacgacttgtttattggtttcatttaagatctcgtgacgaccgccttccagcaaataaactgtcagatgccgctgcccttgctggttcaaatagtttgctagcttacggacactcttgccataatggcccacaggatcttcttttcctgaaatcagcagtaacggcaattcgcgatcgattttctgcaacaggcggggggcactcgctttttttgtcaataaaaacaaatctcgataggcacttaatgaaaaatgaaattgcgtatgcggatctgctaaataagcatctacttgttggggatcactggacaaccaatctttcgccgttcggttgggctgaaaccgccgattatgttgaccaaaaaccagattttccatcacgcgatagggccatgcttgctgtcgaaaaggcatcaacgacttcgtcaataaagcggcactggtcattttggccggcgcttccagtgtcgtccccataatgattgctcctgccaattttgtatttttctgatacaaaaaattgcgcaaaaccaaagagcccatactatgacctaaaagataataaggttgagctggaaactgctccaacgcaaaacgctgaaccaatcccacatctgctacaagataatccgcaccatttgtttctccaaatgtcccatactcgttttgctcagctactgttttcccgtgtcccaagtgatcatgaccgatcactgtgaatccttttgaaacgagatattgagcaaacggatcgtaccgttcaatgtgttcaatcatgccatggatcagctgaagcattcctttggactgtccctccggctgccaaattttcacataaagttgatctttgccgtttgaagatcgaatcatttcttgcctggttttcatccattcacctcatttgcatttacttttacgtctactttgtaaaacgatttgctccgtcccatttgtctttattatacatggaagaaggaaaactgcctatcttggcctagagctctatcagcggctcatcctaattactcaaaaaaaaaacagtatcatggcacgtctgtccatgacactgctttaggatgttagtttgcttcattcggatcgaagaacagccctaaattgaacaagacagatcacagcatggccatttgagccacgccattgctttcagtgttatgatatctaaaccactgaaagcagctctagaaactattctccctcttttggtatgatctccatccgatcgacactcagtgtgtcgaccccaatttctgaagacacttcgattttgatagtgcctgctttcaaattcatagtagtttggataggctgatagtattgtgacggatagaccgccaaacgttggctgtcatcatctgttttcagttgaacatacacgggctcattcaatgacaaataatcttgagttttaagataaacgatgaccgtcgcttcactagcctgtcccattgttggttgaaaaaccaaacgatcttcggtcgattcaaacccttgaaccacttttttcatcaatgcttcctcgtctgtcactgttactaaatcaccttcaagaagcgcatcactggcggtcattcggatcctttttgcttcaccactgggaagcttctgtgtttcattatccgctaaaggaacttctaatttcagcttgttttcttcccatttgattggctgcaaacgaatcgagcgttgccagccagaatgatcccaacgagcagcgtgaaatatcaaccagtcttcggtgccgtctttcgacttggcaaacccattgtgcccgggaccaaaaacagtttctgtctgctgaaaaatcggttcggattctttcgtccaacttcgggtatctaatggatcatcttggcgatccattgtcaaaagtcccagtgcataatcattgtcccaacttccactagccgaatagaccacatttaccgtatcttctttgatgatcacttgaggtgcttcgttaatcaacggcgtttgccgcatttcccattcgtattccggagtcgaaatcagctgcttttcaccaatgacttctgtaggtgagatcatttcagcaatataaatattttgggcaatattttcatatccttcccaacctgaccaaaggaaataccgttgttcgtctaattcgaggacagttccatcaatagcaaacttgtcatccagtcctttgatttcttccaactgccaatcatcactgtaaggatcctggttttcgttgactagtgcatacatccggtgggtttctgagggatgattggccgcaaaataaacgacccacgtaccatccagctgatgaagttccggtgcccagatactttcaaactccgcaggcatttcccagatgacttttttctcccccgctgctacttcagtcagattttccgaacgccaaagggttaagttgttaccagtagttttcgtataataataatatttctcatcttgaaaaatccacgggtctgcaccatcgttgtcgatgatcgctgtgaaatcgtcaaccagcgtttcatgagaagtaccgcaacctcctacgaaaggagtcgccaaaatcaatgcacaaataataccattttttctcattgtctctcctttccaatgttgccgtctgcatatcattcaacttgagaaacatgaaattgatcattgatagctttgattgctgccaagtccactttaggctgacggtcataagtcaacaacccattgatctcctgttcgacatcggtcaattgcgtatagcaatatccccagagccctactgaagcatagacagccgacagcacccgttggtagtcctttaagaattcaacttcattgtcgactgacgtatacccccaacctggttgtcccgatacatcaaagccgatgccaccaaattccgttaacaagattggttgctcctgataagaaaagccgttggcaaaaatcggccacggagtagaaagccgcttaatcagattttcgcgagttcggagggtttctttaaagtaatcatatttctcagtttcttctttttggccatgggcatagttgtgaatggcgcaaatatctgtttctgtcattgcccaaccatcatttgagatcactaatcgtgttttatccaatgcgtgcaagaaatgatacattgcttgagagaaatgttgctgtgttcggtcaaaggaaatctttggcacgccccagctttcattgatcggcacccaagtcacaatggagggatggctaaagtctctggcaatgatctcggtccattcccgcatcagtcgttcaacagaatcttcattgtaaatcgccggagccgcacattctccccaaaccagaaaacctaactgatccgcccagtacaaaaagcgcggatcttctgttttttgatgtttgcggcaaccattgaagcccatttcttttgctagtaagatgtcttttttaaagtcttcatctgacggtgcagtcaagaggccactaggccagtacccttgatccaaaatcaacttttgatagtaaggtttgttgttcaaatagaccatgccgttttccgtatggattttacgcatgccgaaataacttttcaggtagtcaattgtttctccatcgttgattaaagaaagtttaatatcaaataactggggattttccggtgtccaagaccaaccgtcatgatggaaattgcttctgaaaatatgttcctgaaaaagatcggcattgaacttcatttttgccgaatctgcagacagtctccccgctgcgattagctgttctttaaaagagatccgatagtccagttcacactgcggctggaactgattcaagatcgtttcaacagtcacggtcccctcatcaaaatttggagttagattgatttctttcaaataagtctctgaaacgacttccagccatactggctgccaaatcccggtagaattcgtataccagataccagcagattctgtctcccagaattgttttcctcgaggaatactttcatctgcatgaggatcaaatgcacgcacacttatcgcttgctgaccgtcgaccaaataatcggtaatatctacttcaaaagaggtatgaccgccttgatgattcgttacatgacaaccattgacaaagacatccgcctcgtaatccaccgcaccaaaatgcaagactacacgttgactgtccattgcctgcactgtgaatgtccggtaataccagacaatatcgtgaggttctcgttggttgatcccgctcaattcgctttgatagacgaagggcaccttgattctatgcggataggcttcctcctcttgataccatttctcttttagtcctacatttttatcatcaaaggcgaagtgccattctccatttaaattcagccagttttctcgttgaaactggggtctagggtattcatttctgctcatagttcctccaaaaaacaatttattttataccactttgcaatgacattgattccatgaaactcttttgcgccactaaatataaaaggaatgtcgggatcaatgctaaaagagctcctgcagctcctactcccggatacgtcatatattgcccttgcagcaactgaagtcccggcgtgataggcagtttatcaatatcgctcataacgatagaaggccacaagaagtcgttccacgaaccagtaaaactaaataacgcaacgacggttaaaaccggcttgatcagcggcagaataatatgataaaaaatctgaaattcattggccccatcaattacagccgactcatccaattctttaggaatccctaagataaactgacgaactagaaaaatgttatagacacctgctgcgccaggaacgatcacggctagaaatgtgttggtccagcctaatgtatccacgattttgaaattggggatcaaattgacgacaccaggaaacatcatcgttcccagcaataatgcaaaaatcaagtctcgacctttaaacgtcagccgtgtatagccataagccgcaaaagaaacgatcaccatcaccaacaatgtgtgggctgttgaaatgatcatcgaattcaaaaaccagcgaaagactggcgatgaatcattcccctgcaacaaccctaaaaagtttgcgaaagtccactctttaggaatcaggctaaagccaactttttggatctcagcatctgatttgaaagaggtaaaaatagcccatatcagaggaaaaatccagacaatacaaacaatagctaatacgataaatgcgactctttttcctactttattttctcgcatggctgtccccttacctctctaattttttgatcatgataaattgaaagaccgaaacgatcatgataacgatccctagtaaaatcgccatcgccgatgacataccagcaacggacgtactactgccaaaagcattctcttgaatatacatcatgagtactctcgtcgaattgttcggaccacccccggtcagcatcaatggctgtccataaatattgaattgagcaatagtcgtcatgactgttgtaaaaatcagctgattccgaatactcggcaacgaaatccggaaaaacttcactacactgctggctccgtcaagctcggctgcctccatttgttccctgggcacaccgttcaacgcagctacataaatgatcaaatttcctcctaatgtccaccaaatcgttacgatcaaaatcgcgatccaggcccatggttgtgtcccgacaaaattgatatctatcccaaaaacttctttgatggggccaaaggatttacttaacagaaacccccagatgatcattacagcagagatggcaaacaatgtcggcaagtaaagaaccgattgaaaaaagcgcatcatctttggctttgcggacaatgccacagctaatagcaatggaatcgcgatacacagaggtactgatatcactgcaaagaatagcgtgtttttcatcccattgaaaaattgcgtatgatacagcgagtcttgatcaaatagaatcgtcttaaaattgtctaaaccaataaaaatcggtgaactaaaaagatcccattcggtaaaggaaacataaacaccaattacagcaggaaccaaaaagaataaaataaaaagaatcatgtggggaccgataaacaaaacgggccaaccactgagcttttttttgctactcatacattacgcatcctttcatgccttgataaaatcgactagaaaaagactgtgacaaaaaccacttctgcatggaagatgctctttcgtgtaagttgccaagctaaccagatcaaaaggccactctttgagaaatcttatatgagtcctcttttggtatgtgtcttctcgacatgcctgatcactatcttctttgccttcagcttttgtcacagaccctgcgattatttcattttctcttccacgactttttggatttcaccaaaggtatctttaatatcggcttttccagtgatcatgtcccaagaacgattgtcgtattcatcaaaaatgtaagacaatccatcgactgcattcacagagatcgccgcctgtcctttttctgttttcaacaagaaagattgcggcatcttgacatattcctcattgtcaagcatcgctagtgaagttggattggcgccagatttcacccattctaactggtttgcctgcaaccaagtcaagaaatccaccattccctctttcttttcatcagagcgttcttcttttgtcttaaacatcgcaaactgatcaactcccgatccttgaacgatattttccgcatcccattgcggtgtaaaggtttctccccactcaaagtcactgatttcttccatattgctcaacatccacgttccttccggcaagaagatcaactgttgattcgcaaaaagtttattggcatcttccccgtctggcaccatgtagcccgcatcatacaaatttttgaattcctgtaccgtgttatacgaatactcattatcgatattgattttgccatcttgatcttgccattgtccgcccatttgctgatatagattggaataattctgcatcccccaggtataaccaaagctataaacgccatctgcttttgctttttcacctgcctgattgatttcttcataagtcacgatgccatcatctaatgctccaggaatgtatttgtctaccagatctttgttgtaatacatgacccacgaccccatggtggcaggaatcccatactggctgtcctcaagagtaccggtatcccaagctgcttcaacataattgctgcgatctagctctgtacctttgatcatgtcatcccaagaatccagcatctcttggttcttataggtgggaagtgcttctgaagcgactaaagccaaatctggtacacctttccccgatttacctgctgtagttagttttgaggtgaaggtatccccttgcatactcactaatttcactttgaaatccggatccgtcgcattgtattcgtcaatcgtctttttgattttctccccatctggtccagttgtggatgaccataacaaaatttcagaactcttgcttgagttgccgccgccacttccacatgctgacaatacgatgccacacagcaacgtcgcccctactactatagctgctttactaaatttcatttttccacgctcctattatttaacttatttgtaaaacgatattccaactcactttacttttttcaacaacaataaaaaccaaactgtttacaccgttaaattaacatcaaaataaagcgctgtcaacagctatttaacaactaaaataaaatatttatatcgtttaactatagtgtaaaatcatcaagttatgttataataaacctgcgcaatcaattaacaaaaaagtataacgaggtgaatagaatggaattaaatttagagaaaacctctttaccggtttatgaagctttagccaatgagacgcgtttggcaattttgagagagttaggcggggaaagaaaaagcatcagtgagattggggaaaaactggcaatcagcaacgcactcatgaccaagcacatcaaaaaattagagcaggcacaattgatcagattagaaaaaggaacgggaaaagattggaaaaagaagtttctagctttaaagactgatttcatcaacatcaacttccccgaaaaagtatttccagaaatgaatttgacttcattacctgtgaaaattggtcacttcactgattttagagccgaagcttcttgtggaatggctacaaaagatcgcctgatcggcgcattggatgatcctaaatcctttttggcacaagaacgagtagatgccagtattatctggttaaacaatggattcttagagtacaaaattccgaaaccgctaaaaaatggggaaaaaatcgaaatgctggaaatcagcatggagattgcttctgaattccctatttccaataattattggccgagtgatatttctttctatatcaacgatgtctgtttaggaacctatactgttccaggaaacttttcagatgtacggggggcattgacccctcaatggtggatcgatgagttcagtcaatacggcttgttgaaacatctgcggatcaaccgttttgatacttcgatcgacggagaaaagctgaccgaccataacttaagcgagatcgatttggatcacagtgatttctttacattcaaaattgcagcaccggcaaccgcagaaaacgctggcggtctaactatttttggcgatcgttggggcaattacccgcaggatctgcttttcaatttttatatttcggaataaaaaaagacacaggcaaacaatcacctgcatcacttgatgatctctgttaactctcctttgactgcaagatttaacagggatcatttgctatggcgggattcgtttttctgtgtcttgattgctcttattttgcgctggctacggcaaagattcgttcgatcaattccatgacgttgcgaacttcttcatttttgacaattggttcagcaccgtgacggactacatgataaaaattcttgtagaaaggatcaaaatcggctttcgcttctggaaatgggattgattctgcagccaattcagatggcggtgccattgttttcgttaatccaacacctgcttggacaggtttaggtgcggcaacatcttcgcggccagttgcccgaaccatcttaccattcaacgcccaatcttggatcgtagcagttccttcaattcccttaatgtaccagcgaggcaattgggtgtaattggaggtcccaacttccacgattgctttgacaccattttcaaatgtgatcaaagcaaagaatccatcgtcgacttcttctcccagaatatagcttaagtcagctttcacatctttcactggactgtccactaaccaaagtatttgatccaacaagtgaacgccccagtctaataccatgccgcctccttgttttttcacatggcgccaatcacctgggatgccatttgcaccttggacccgtgattcgatttggaaaagatcaccgatctgcctattacgatataaatcgcgaacgatcagaaagtctggatcccagcgacggttttgatggaccataaatgtattgcctgtttctttggccacagcaacgatttcgtctagttcagcagtgtttaaagcaacaggtttctcacatacaacatgcttacccgctctgagggctgcgatcgacaaatccttatgcaaatcattcggcgttgcgatcagcactgcttcaatggtttcatctgctaagacttcttcataacttttatagattttatgccctttttcttgtgaaatagcttgtctttcttccgaaatatcataggttcccacaatatggatccgttcattttcattcggcaggatgttgtgcacatggtaagcacccataccgccataaccgatgacaacaaaattgattgcactcattttctatactcctcgttacacccaccacattgcggatggttcttctttgatcataatcgatttcaaattagtgattgctcggttcaatccttcatcaacagacatgattggatcttcatgctcgatactcaagacataatcatacccatagatccgcaatgcggaaatgatgtccgaccaaacttgcaagctgtgcccgcagccaacagagcggaaagtccaagctcttgttttgacattgctgtatggctgcatgtctgtcaacccatgcatgttgatattatcttgatcaagatacgtatctttggcatgaaaatgatgaatcgcatctgcttcacctaaaatcttgactgctgccactggatcgatcccttgccaccacaaatggcttggatcaaggttacaaccaattgctttacctgcagcgtcgcgaagttttaacatcgtataaggcgtatgagccaagaatccgccatgcagctcaataccgatttttacaccagcagcttctgcctcggtattgatttctttccaataagggatcagcttttgctcccattgatagttgtaattatcatcgtattccgttggccatggcagaacaggccagttgacttgcgtgtctgttgcatttcctcccgaaacaccagagaatccattgacgacagggacattcatcaaactggccagcttgatcgttttgcgtaataattcatctgcttcctgcgcttcattttttaaaggcgaaatgggattgttgtgacagcttaacgccgagatttctagtcctttgtcggctaatttagctaaatattctttccggtctgcttcactagcaagcaacttatcgatatccaagtgggcattgcctggagaacctcctgtaccgatctcaactgtctgcaatcctttttctgcaacttctgtgatcatttcttcaaacgttaaatgattgaataatggcgtaaatactcctaatttcatttgcctacctcctcattggcttgataatggccgtacgttgggtacgtattttctgttggtgcgcaccaacgtgccgcgtttttgataactttttgtactttttcgttgtaataactcggaaacgtctcatgcccaggttggaaataaaagatcttgccattgccacgacggaaggtgcagccgctgcggaagacttcgcctcctgggaaccagctaacaaagatcaattcgtctggagttgggatgtcaaagtgttccccatacatttcttctttctcaagttcaataaattcgccgacaccttctacgattggatgactcgggttgatattccaaattcgacaatgctgatcatccacgcgccatttcaagtcacaggaagtgcccatcaatttcttgaagacttttgagaagtgaccagaatggaggacaatcagacccattccttctaacacccgttgttgaacgcgctgaacgatttcgtcttgtacttcatcatgggccatatgcccccaccaaacgagcacatcggtatcagctaatacttcgtttgttaatccgtgttctggttcatccaaggttgctgtgcgaacttgaaaatcatctgcttgcaaaaaggcagcgatttgtccgtggattccttcgggatacattgcctgaacggtttcatctgttttttcgtgtctaaattcattccaaacagtgacatggatcattggtaaacctcctcaacgatagcttttaattgcaaataatcgatggccgtcgcttctaaaggtgcgtatttttggaacgcttcttgttccacgatcaaccaaggcaattggaattgttgcgcaactgtgacatagtccttgataggtaaaatgccattattgatttctgtgctttcttttggttcttcctgcatatctttgatatgcaaaagaccaacggactcttgatgttctttcaaccaagtgaaaacatcagtgccggaataagcgatccaataaagatctgcttctaatttaagtgctggattttcagctaacaattcttcaatcattgatttattaggaatctcggtaaattcatgggcatgattgtgatagtagcattcaaagccctgagcagctgctttcttagcaacttctgcaaactctcgggcaaactgttgccattctgcgaatgtctcaaatgaagcatatggaaccacgagtcggtgattcccgatcgctttttcataggccagtgttgcttcaaaatgatcccgcaatgtttcaaagggtagatgagaagcagcaactcccaagtcgtattcttttagcgcgtttgagacctctgttgcggaataaccgtagtaacccgcgaattcgactccgtcatacccgctttttttgacactttcaagtgcttggaacaagtcttctttacacgcttcttggatgctccataactgtagtccgatttttggtttcatgctttgctcctttttagcgactgcttttacaagtagaccggttcgccagttgctgaggatttgtagattgcttctaaaatctcagtaactaccattgcctcttccggcttgaccacaggttctgtgtcattgatgatggcgttgatccaagattgtgcttccaagatttcaggcgtttcgccgtccccttcatagaagtcgacaccaccagtttccaactcaatatttttttcatacaacaaactatgatcttcgccattgattgttaagccattattcatatccgcgccagctttgctgcccatcaatgttgtttttgcttctttgacatctaaactgttcaacgcccagctagcttccaagaaaatcgttgcgccattttccatcacgacaaatccaaaagcagagtcttctaccgaaaacttctctggatcccatgacccccaagcgttcgccgcattctttgtctgagataattcatggtaagcttttccgacaacaaatttaggttggtagttattcatcatccacaatgttaaatcaagagcatgcgtaccgatgtcgatcaatggtcccccgccttgagcttcttcgtctagaaagacaccccaagttggtactgcacgacgacggatggcatgggctttcccaaaatagatattgcctaattgtccttccgcacaaacctcgtgcaagtagcgggaatcttttctaaaacgattttgataaccgatcgttaattttttgcctgttcgattagcggcatcgatcattgcttttgcttcttctgtcgtttttgccattggtttttcgcacattacatggcaatctgcttctaatgctgcgatggacaattccgcgtgagaagcatttggtgtacaaacatgcacaacatctaattcagcttctgctaacatttctttgtagtcgctgaatacctgggcatcttctgtaccgaaagctgttttagcttccactgctcgttcgacgatcaaatcacaaaatgcgaccatttccgcttcttttacttgtgataatgccggcatgtgtttgccattcgcaatcccaccgcaaccaatgattccaattcttactgtcatctctttcctcctgaaaacgcttattattttctactcattcattatagcgaaaggatttgacaggttcttcccaatttcctcttaaaaaattcccgaaatttatcttatggaactctcactaaaacgaatcaaagactccttcacaccaaataaaagcacccaaacaaacagtgaacaatcgcttaaaaattgcgcttgttcaagggttcgagtgattgacaagattggctcgttgatctagctttcatcaagtattcaattatttaattgtttctgatactgcaatggggattgtcctacggtctctttgaacacgtgatggaacgttttgacactggcaaatccggctttttccgctacttctgccattggaagtttctcgtttgccaaaatgaatttggcttgattgatccggtattccgtcagaaactgcatgaatgtttttccagtattcgtcttaaaaaagcgggtaaagtaatggggactgaatccaacatgcttcgctgtttcttccatcgttaagacatcttggtaatgggattcaatatattcaaacacttcatccagacgttgcagcgtttctttgtattgagctgcagaacgttttaaaggagcgatctttttggcacgcggcggcaacccttgataacattcgccgatcaactgatacaaaaaacccatagtcaaatagcgtttaccagctacttgctcttcctctaactggtagagttcgatcaacaatcctgtgattttttcggtaaaactgactggccaatgcttgctgtggggttccccctcgtcaaaaagtgtttttaaagaaagttctttttctcgcaaaatggtttcatcaaacagtgcgaaatcaaactgatacacataacgctcactctctggagaagccaaaaaatagtggggctggccactggcaaaaatgtacagctcgccttcttccaactcaatgatctcatcagctaccccaatattgacttttcctcgtttcgcataaatcagctcgatttctttatgtacatggggataaacgatcgtcagcccatcattaaggaatgtccgaaagcgaaaatcgctttcaaattccggaatctcaagatacatactcatactgctatttactcctttgcttccattctcatccattatagaacaaagaatttttgtacgaaatgcttttctgattttttatgaaaaaatagtcgtttctcgctttttatggtatcttgtacaaaaaggaggttattatgaattactacgatcagcatttgcatacttttttatcttttgattcagaagaacgcttcgaaaattatttagcttttcaaccggaattttttgtggcgactgaccactttgatctcaagaacccttattcaaattatcgcgatgatattcccgattatgaacagcttcaacaatgccatcagactttacaggaacaaacagcaacgaaacttttgaaagggatcgaaatcggtgtcgttcctgggcaagaaacacaaatacgcgactatctggatcagcatccttatgacctgaagttagtcagcatccatcaaaacggttcctttgactatatggatgatgccgtattggagaaagacaaacttaccgtcgtcaagtcttattttgatcagatggccacagttttagatactttttctgacggacatatcctgacccattttgactacgggttgcggcgcttcgactttacagcagaagaacttgcacagcatttcgaaaaagaactgacagttattttcaagaaagtcgtcgctcgcgagctagcttttgaagtcaatgccaaaagctttggtccttatcaaaatgcatcactttacgaatatgcgatcccgctctatcaaagtgtggggggcaaactctttacactaggttcagatgcgcataagtccagtgattatcgcttgttatttgccgaaatgagccagatgctgtgctccttcggtgtagaacaattggccgtctttcaaggaaccgaaagatacatggcagatttgcctgaaggttgagggaggatactgtaaacaaaaacttcttcctgcgaagcatccgtatagctagtcgaataacaatagcagaaaaaatctatccggagaatggatttatttctttccatcttcaagatagatttttctcgctttaagatcgttttaatgaaaatgctacttcgctcttagttcattgtttttcgtttttgcacatgcaaacttttaattttgttacttttaaaaccactgctgaacacagcgatcgtcactacatataaaatcagcgggataacgaaagtcacgaataaaatccctttttccgcagtgcttgattttgactgattcgctgcatagccggtaaaacttaacacaaatcccggaacagcaccacctatagccatcgcaaatttcatgattaatgaagtgagagaagcaatcaatgctgtcgcctctatgtctaattcgtttcttatcgtatcaacattatcggccgaaatactgtattgcagtgtattcgtcaaccctaatgcaaattgcaccccgcaatagcataaaacgaaaacggctgagtgatgattgatgaccagaaatcccagcatacataatgaaatcaataccaaacctgtaatgtacagatgtttttttccatatcgctgcgataattttggaaccagaagccctgctgccaatgcccccagcatacctaagaaactggctgcactcaataatttagggttgctaataatataactaagataatatagaagtgaaccattgaagatgttcgttgccgctgtaatgaatagcattgctagaaacaatgaaacaactggacgcagtttgaatacagataacgcatccttcattgtatatttttcttttaccggctttgttacataggcagcttccgtccctctttcctttaccatcaacgtccctacaatcgtaaaaaatagaacaactagtaccgtccctacaatcaataaaacgtatcctttcaaagacgttgcaaaagctgcgattgccaaaggtgctgctacatttaagatagctggacctaccgtatatgaaatccctttgattgatgaaagttgattacgcccttcatcctcttgcgtcagtacggggattaaactattcaaaggaatatccataaaatcaaaagtaattcctagaaggatgtaagaaatactaatagcaatgattttttgagctggaaataggagaggcgaaaaccaaacaagcaaatagtttaagcaacagatgatgactcctaaaatcaacacaggtttgtatttccctatctttgttcttggaaaacgatcaatcacaaaaccaataagtggatcactaacgccatctaaaagtctcgaaacaaggaataacattcctaccaaagctggattaacaccaatgacatccgtatagaaaattaacaaatacgtatttaatagtgtcataatagggatattccctagatttgttaaggcaaatccgagtttttcagacacttttaaccgatcactattcattgctttcttcctttctttgatgaatccagcttagaccttttttacaacctcataacttacaggttgattggcaaacattggctgctcttttccatctatccgcaagatcccaccgtctcgatttgtacaaattgttaagcacgtatctgtcttctcaatcttcacccagccacctttaactgggaatatacacgttaattgatgaaaagaatcgagcttagggtcaactaagaatgtttcataacctggtcgaataggttgaattcctgcgaaataacgtcctaataagtagataggactggctccccatgcatgacataaacttttcccaaaaggatccccatacatttcataaatagcatttccactttctccaggaatatactcctcccagaaagtaaccgcttcttgttccaccattccaccccagtagtcaagaataatctcatgtacttgacttgtctgtcccagtttacaaagggcatcttgttcgaagaatttgaagtaaggagttgtgatttgagtgacttcatcattaagcaatacatttttcaaaatttgttgctttttcgtttcatctacaaagtcgaataagaccgcaaaaatattggcatggcgtgtcacatttctctttccagatagataagaatcaataaatgcccctttttcttcatcccagaaataactcattaaattagctttcaactgttcatatcttgtcacatagtgatcaatatcacgattcaagatagagccacaaacagtcatagctttgtatgctttcaataacaggacttgttccgctgccaatgtcccttccttatccatttcagaccaatcaataaaaatccagtccttttcgcgaccataaataaatcctaactcatgggtttgtttttcaagatagtccatcatagtcaccattttcgaataaatctgtgcaagaaatgagctgtccccagacatcatatagtgattttcaatccctatgatccataaaatggaataatcaacaattgtattcatatgctgttttacttcattttgacctcgcaatgccatgatcgttcgcttattgatatcttcatcaaagaataagtattggttgataaaatagctttggtaagcatcccctgaccagatccagcgatctcgtttgattccgtcaataaagaaaagcccactgcacaatgtaaaggtttctatagatatatcccatattcgattcatcacagagtcatctgatttgaatgtggcttgattgtgtaagggaagatattcatgcatcgcacgaatatcaattgcttctggtgctatattaggaatgaaaagataacgaaaagcacgtttgcgaatgtttgtttcttttcttacattttcctgtttgtaataacacatttgactatcacatgcttctgcttctgattctccatagcaaatagatatcggtatctccgacaacaatttatcgatcattaatgaaccgaaaatcgtccgtccataatcaaacaacgtgccgccagcaaccgccgtcttcgaaacagggaaacaagtttctatttcataatagactttattagggtcttgctctttattcatataaagattgctccatcctactggagcttcttcaacaaagttactgcaataccagccttcatcactcttgattctttctccttcaatatagatggctggcaaaccgtttggattccctacattcaccctaatcttattaaaaccgggttgacagacaatctcttgttcaaaagaatatttcacttcattcacttctacaaagccaatccctgttgcatatacaacaaatgtcgtgggactttgtaattcatattcacgtttaaattttacatttttatggcagtcatcaatataccagtaagctggccaatcgtatcctcgttcttctctagaaaaattttgtaaaagtccttgacgtatttcaaaatcgccagcataccagatccatcgtggccgttcatttgttatcactattatccgttcctttcgtttactcatttatattctatcgatcaactactttactaaatcagctagattagaatctcttcgactgtttgctctcgttttagctcctttttgcaatttcatcatgacagctcctgcaatagctgctactagaacaatcgccgcaaagccatacatcgaaaattgaatattgtttggcgataccaaaaatggtgtgacaaaggcaaacaatccgcaacacaaccgtgaaaaaccattgataatgccttgtaagaatgcccgagattctgttggaaatgattcttgagtccaaactttatagatggcttcccctgctaatggatttccaaaattataaaaagcaatcgttatcgccaatgcgatgaatcctgcactaccgccaataactgccataccaaccattgccatgaattgaacaaaagcgccaacaaaaaatgctttattccgatgctttccacccgctactgaagcaaagataatcgtagtcactaaagaaatgatattcagcacaatacctagccctgttgcttgcatttgtgtagcaccagcattagtcaaagcgtatgtctgaaattgtccccatgtattcgctaacaaattccaacaaacataaaagactaaaatagcgaagaaaaagttgcgataaatttttgcattattcccactaaaaatctcttttagtgaaattttttgttgattgctaaccagattcaacgcagactgacgtgctgcaccttcttcgtggaacatccgaaatttttttgagactgtccgccaaacccacgcaaagattgaaaagaccaataaaataacaaaaacaatacgcgctcccaaaactccattgactccggaaagtaagaaagaacaaatataagaaataaaaataccaatttgccaaaatatttgtgtcgaagatactaaacttgcagaagttttttcatctggtgcatcatgagagacaacggttaaactgattggtaaatccgccccagatgcaatccccatgacgatgactcctaataataaagccacaaaatttcctgaaaatacacaaattgctgctccaatagcataaaacaaattgatccagttgaacgctcgaatcaggccgaagatttttgtaatttgccctgcaaacaaagagccgaacgcaattgcaaaggttagtgcaccagagattaatccaacttgtcccgcagataagttcaaccctttttgccaaaccggtatagttgccgagagaccgacgatacatccagaacccaacatagaacctacaccggctgcagttgctaaaagagaatactttttcactaatgattgctgctttccatttgtgtccatttgaaacaccctttcttgttcatagggttatattaaacgcttacataaaatggtacaatttcaaaaatgtaggtctttactatcaaattcacaggtcataaatttgaatttttttgaaaggctatttgtttgatctgacaaaccctttaatagcaaagtaaatattgactatttattgggaataacttatatatagaactaactatataaaaaaattaggtgattgacggatggaaagtttgattaaactttttgatatagaagatcgaattgaagcccagcaaagaactactgggaagaatattaatgaaatgaatttagactatcatggatcagtaattccaaaaatacccgttaatgatttttttgaagagggatctatttatatcaataagcatcatcgctactcttatacgcctgctcatactcatagtttcattgaaatgaattaccttctaagaggatgttgtcggcaaaaaataaacggggaggcatggaggttcactgaacagcaattgattattatggacactgaagtgattcagcaaattgattatgtaggaaaagatgatttgattctcaatattttaattgacaaacatactttacaaacagagctcttgaaccacttgcccgcttcaagtaatccagtcacggacttctttttgaatgctgctaaaaaggatagtgttcataatacttttttagtttttgatttaaaagaacacgcgatcatcaatcagcttttattcttgatgattcacaaattttatctcaaagaaatcttctatcatcgttccttaagtctccttttaggatcatgtttattggaattagcagcaattcctagtttgaatgaactgtcgttaacttctcaaagaaatgatttagctgcactcttaaaatatattaacgatcattacacaactatcactctcaaaaaattagccacggagtttggttataaccaaaactatttaggtaatatgctcaagacaaaaactggcgcgacttttcaagaaatgatcgaccaaaaacgtttgattgaagcacaaagattacttagagaatcttccatgactattgatactatcgctgaaaatttaggttacaagagtacgccctccttattcaagctctttcaaaacaaaatgcagatgactcctactcaataccgtcacttttcaaaaaaagttaattaatcacaagtaaaatttgtaataagcaatagcaggaaaaattctttatcgtcaattgaattaaagtcactacgatatgaacaaaaaaaaggatccggaccataaatgtttgattgctcctgaacgtccaaaatgtgtgacgatgttctcctaaactaccagggcattacatagatgattcggatcttttattattagacttatatcatagttttttatttttactactacttcgcttcaagcacatcttctttggcatggatcaattgggtcaagaagtcgcaataaggcgtgggaacattgtattttcgacctttacgcgaaatagccccgttgatgtaatcgatctccgttttacgatgattattgatcaaatcttgatacatggaaggatagtgtaagccaatacctgcaggatcataggttttttcaatatgggcaacgacttctggaacatctagttctaccgattcatgagccgcaacagctgcgaattctccaacaatggtttgcaccatttgtcgtgcagtggctgtatttccaaactgtgcaatgttgacatccaaaattgaacataaaccattcaatgtaccattgacacaggctttacgatagattgaatagcgaatattttcagagtatgacgcattcaatccagaagcagttagtacctcagccagttctttggccgctgcttctttgccttcaccaatgttttgcagttcaaccgatccttccccaaacaatcgaacttgcccaggtccaatcaaatctgctgtccatagggtatttcctaagaaaattttatcggtagcgacatatttttcaattgtatcttcatgtccaatgccattaagtaagcaaagtactcttgtttgatcaccgattagtgaagcaatgtcttgcatcatttggtctaattgcatcgcttttgtaaaaacaatgatcagatccgctggcgtatccgccgttacttcggactgtggataaatggggaaagattctgtgatttcttctccatccaaatttgcttgtagtccattggtacggatcgcttcgatatgcgctggccaaccatcgatcaacgttacatcgttgccgcctctttttaatttaatggcaaatcggctgcccatggcaccagcaccagcaataacaattttcatctctattcctctttcctatctgacaattaggtatagtttactccaaatcaaacaaatatgcgaggagcttgccttttttaaagtgaaatttgttaaaaaaatcaattggaatcgtttgatttttcagataattaaagaacaaaaaaagatccttttcaggatctttttaaaccgtcacttcagacgctagttgtgctaaaactgctgcttgttcttcttgagagatattgtgctcaatgacgtaacgattgttttcattggcggcacattcatagcagcagccgcctaagtgtgccgcttgattctcttccgaagtgaggaactgacgattgcactctggatttgcacaattgacgtaacgctcacatggtgtgccatcgaaccaatcgcgaccgatcacggtcttgtcgacatgattgatctcaacactgatacgttcatcaaagacatacatcttaccgtcccacaactctccttgaacttctggatcattgccataagcaaaaattcccccgtgaagttgtgctacgtcttggaatccttctcgcaacaaccagcccgagaatttctcgcagcgaatcccacctgtgcagtaagtgaccacttttttatccatgaatttctctttgttctcaatgatccattgaggcaattcacggaaactgcggatatcgggacggaccgcacctcgaaaatgaccaagatcgtattcataatcattccgcgcatcgatcactacggtattttcatccaacaacgcttctttgaaatctttcggttctagatactttccggttagttctaaaggatcgatatcatcttctaagttcaatgacaccaattcttttcgcggtcgaacaaacaattttttaaaggcgtgttcttccacctcatcgattttgtagtagattcctttgaaacgggggtccgcttccattttttccatataggcatccgttgcttcaatcgttccagaaagcgttccgttgattccttctttcgcaacaagaattcgacctttgataccgatctctttcccaaaagctaaatgctctttcgcaaaactttctggatcttcgatggtcgtgtatttataaaataataaaacgcgatagttcacagtcattcctccttttttccaccctacagtataaaaaagaaaaatgaagaacacgaattttatgcttgtacataaccacacaatccctttgcttacctagatacctgtcgttttttgttgtcagagtgaatcagtgctttttcctaattgttcaacaaaaaaggccgttacctgatccatggtctctccacgaactaaatgtcgttcttcgcgagagataaatgtcagattcgcttctggattcccttgcacaaaggtttctacatcggcgtaaggtattttctcatcttccgtcccatgccagaacaacaatggacgtccagctagtttttctggttgcgtctggagatcataagcttcgatccatcccagtagcaactgatagtcatctgggacaaagaaacctgcagcacccgcatgtttctggatccgttcacggtaaccgatcatcgatggcgagcccatcacacacgcagcagcggtgatctccgggtgttgacatagcaagccgcaagtcgtcatccctcccattgaaacgcctcctacagcgatttgcctatttaccaagcctagattttcaaagaaatccaccaaataagaaaactcaaataagttggtatgaatgctttgccagaaaatcaatgaaggaatctcggatagttgggtctttcgttcgccatgattggcggcatcaggtaaaatcacacgaaagttttcccgtgctagttttcgaccttgcgtcagtaccaattctttactcgtttgccaaccatgataataaatgatcaacggcaacggttcatagatcaaatgttctggaacgacttccaatactgggatattcccgatttttcttttacgaactgcaattttcatctctttccacctctgcttaagtatacgcattctgctcttacctgccaaataatcccttcaatcacaaaaaaatcacaccaatgttttggtgtgatcacatgtatcaggaatgtaacacagcttctcgtgctagtgccagacagcctaatgttcctgcattgtcttctaattcaggtgtcacgatgtagtctgcaactgctggtgttttgacatagccgttgaccaatcgttcaaaagcttgatgaaccttttccaccatgtgacgctgcttcattacgccaccaccaaaaataatgacatccggtgaaagcatcaatgtagtgttgtaggcgcattgcgcgatatattcagcttcgatgctccagaaaggctcatcttcagacagttcctgtcctttctttcctaagcgtttttcaatcgctggacctgcggccatcccttcgagacagttgccatgaaatggacagctgccttcgaatgaatcatcaggatgaggcactaccagcatatgtcccatctccggatggctgaatccctcaacaaagcggccatcttgtaatgcaccgccgccaacaccggtgccgatcgtataataaactacactggatagtccttttcctttaccgaaaacatattccccataagctgcagcattgacatctgtggtccaagcaatggggatgggaaaggcttgtttcatcgtacctacaaaatcaaaattctgccaagctaatttgggtgtggaggtaatgtagccatacgttgcggaatctcgatggatatcgattgggccaaaggaaccaataccgatccccactaactggtcttcatactttttgaaaaaatcgatcactaatgccattgtttcttctggtgtggtggtgggaaaactgacccgttctttaatggtcatttcttcatcaccaatcgcacaaacaaattttgtaccgcctgcttctatcgatccgtacatcttttcgtctccttttccatcgttgctttcattttctgtttaagtactggcagaactcgcagctgcaccatcatcggcttttacgcgatcgatggcaatgacgagacaaataatcaagtcctccagatcttcctcataaaccgttacttcataggtatccccccatgagatccatcgtttatgaatctcagcaatttgacgtccctgtcgattgacgacaaagtccatgtcccaccaattcccctgaatttcaattccttgggcatggatggaataacgcgctttgaaaagcgtgaattctttttctagaacaattgcttcttctccatgtacctcaacaaaaaacttgggcaatagactaaacactttctttgtgacttcaccgatttgctgttgtcgttcatcataaatcgcaaagcttttaggaatcttcatgaaactcccttcgacaaaatagcgcggcttttgctgctcatccatgacagtaaatttttcaccgatactgaagactttttgcttgatgtaaagttttttcatttgattacaccgccttttctttcacatcgcctgtattgatcacaggttgagtgcctttgtcagtaatgatcgatacgagtaaattgttgatcaattggacttttcgatcgtcagtaaagttaatatcctggccatcttcgatctgttccaaggccatttgtgtcatggagaccgctccttcaacaatgatttgtcgtgccgataaaattgctttggcttgctgacgctgcaacatggcactagcgatctcagtggcatacgccaagtgattcaaccgcgtctcgatcacctcgacaccggctaccgctaaacgctcttgcagttcttgtgccagttcttcagaaacttcattggtattgcctcgcaaagtcaaatcatcatcattaaaagtgtcataaggatactgggtagcgatatggcgaatcgctgtttcactttggatctcaacaaaatcttggtagtaatcgacatcgaacaatgctttggccgtatctacgactcgaaagacgacgactgctgagatttcgatcggattgccatcagaatcattgaccttcaataaagagctattgaagttacggactttcagtgatacattgattttctgtgttagcggcacagtcacaaagagtccattgtctttaatggtacctaaatattgaccaaagaaaagaatcgctttcgcttgattcggctgcacaatcgtcaatgaactaatgaacaagatagcgatgatccacaacacgacactgatgactaactcccaaaccgcattgcggacaatcccatcataaaagagatagccgccgccgatcattaaggcgatcaagacgatcagtgctaagtaaccgttaacatgaaacgtttgtttttctttcatctttactccctcatttcttttaataccatattacctttgttcacaaaagacttcaattcttcttctcatttttttaacccctttcatagacctgcgatcatactattttgcaatcaaccaaattcccgctacaatgaaatgagagtcaattgacaagaaaggggtatccaaatggcacaaaaaatttcattagaaaacgtaaaatggtcattagaagaaatcattcagactgttgggactgatctatcttctgttgtcgaaattcaaaatcaagaaggaatcgatgtcgtggtgattgccaaagatgaatggcagcacctcttagaactactcgatgcgcgccatgcacaaggctatcgaatcgatcaagaactgccaacggatatattgattgacgttgctgatagcgacaacgaataccaacaaacagctgaactagagatggaattaccggaacgtgtccatccagcaccagactttgaattagactcagaagaaatcgttgaaagcgatgatgtgctggattaagctgaaaaaatagactactgtgaaaaatcttcccctaaaaatagcatccattcgaccaatagccgagcaatgtcggaatacttccagacttttcaggtcatgtcgcatttgcggcatagttgacgtattctaaacattgctcggctctttattataaaaaatcgcgtgctttaattttttgtacgattgctcacgtgcttatggagttccgcctagcacgcaatcaatcaactgacttgtttttccgatctgcaccggaggatgccacgatcgtttttaagcgttcgatcgccgcttgtagttcaacgcgtgcttcttcttctggttctagttcttcgcattgctgtaagcgttctagccattgttcgggttctttgatgcctaattgtccaatggcccaataggctgttccacggatgacaggtcggacgtcttctgtcgcacaccgccagatggctggcaatgcggtgcgatctcccagatttgctaaggcaatgatcgcattacgctgcaatggtttcttcccgcgccaagaaccagataaatgcccaaactgattcttaaaagctttatttgataaagaaagcattggctgcaacttaggataaacggtttctacttccggttccatttcctgatgaaaatggaaatccttgcctcgattgtagggacagaccaactgacaaatatcacagccatagatgacattatgcatctttttacgatattcctcaggcatcatgccttttgtttgtgtctgataggaaaggcagcactgtgcgttcattcgcccatcccctaagagcgcttttgtaggacaggcagtaacacagcgcatacaatccccacagccaaagggtaccgcttcatctgtttcgaaggaaatattggtgacgatctcgcctaaataaacaaaagaaccaaattcttccgtgatcaataagccattgcggccaataaaccccaaaccagcacgctgtgcaactgccacatccaccagctcaccggtatccacttgcggggcaaaccgccagctttctgcttcttccagattctctgcttgcgctttgataaactggatcaatttttctaagcgatcacgtaaaatatcatggtaatcgatcccccaagaggcgcgggcaaacatcccccgtttctcatctcgcggcactttctctttgatttttgtcggatatgccagagcgatcgcaatgattgtttgcggattttcaaaggttctttctggatatatccgctcttcgatcacttgatgttcgaaaccagatgtatggcctttcgcgcgctgctccctcaacgaggactctaattcataaaacggttcagcagaagcaaagccgattttatcaatacctaaacgcttgctttctgcgatgattttctcttttaaagacatgatatactcctatccaacatgtgttcatcagaccttcgtctttgctttttctattatacgagaccacttccgattagtcgaatcgctgccctcaaaaaattcaaacaaaaaactacctaaacgctcggcgtctatctcccagtctttttaggagatcagctgcctcagcattcagatagttttccttgaatacccctccatacagcgcatttctgagctatctagaagggagatcgtttgattgtattatttttgttacacctattaaatgtttaccaactagctttttttacacctggcaatttgccttcatgtgccaattgtcgaaaagtgatccgtgaaagaccaaatttacgcatatagccccgtggacgaccatcagtcatatcccgattcttcaagcgattcggattagaatctttaggcaattttgctaaagcttggtaatcttttgcttgtttcaattggtaacggatctctgcgtattgctcgatcattgaggcttgtttttttgcttttgcttgttttgattttttggccattattttctcctttgttttttctatccatcattctaaaaagaaaagaaatcagctagcagagtcctccattttcgattcaaaaacaacaaatcgaaatcattactatttgagcattatgactatatcaagtttctgggaacaagtcaatgaaaagccccttctttcgaacaaaccgctactgttttttaagatttcaattattttttcatcatttcttgcaatgacttcttggcatgctagactaaacaaggaatctgatagaaatggagaattatatgaagcaaatagatacgggacttacctcagaagaagtcacacaacgaaccgaacaagaccaacacaacgattatgaaacaaaaacatcgaagtctacgacagcaatttttaaggacaatatcctcacattgttcaatttgctgaacttgttgattggtgtctgtcttctggcagttggcgcctattccaatttattttatctggtaatcattttgatcaatatcactgtagggatcagtcaagagatccatgctcgaaatctagtcaaaaaactctcgatcatcgcccaacaagaaatacgtgtgatacgagatggcgttacacagtcggtggatgccaaatccctggtccttgatgatcttgttgtcattggtgcaggagaacagattccagccgacatggtggttttatctggacaagccgatgtcaatgagtcgatgctgacaggcgaagccgatctcgtcgtcaaagaaaacgacgcgactctcttatctggcagttttgtcgccagtggagaggtcactgcaaaagtgatccgcgtaggagcagagaattatgcggcaaaattaagcaatgaagccaaaacacataaaccgctgcgttcagagctagtttcttcgattcgcaaagtcacaaaattcaccagtctagtgattgttccattaggggtgatcctatttctacaagcttatttatttcgtggtagtgacttaaaagaagcagtgatcgtttcgtctgctgctttattgggaatgctgcctaaaggactcgtcctattgatcagcattgctttgaccacgggtgtcatcaaactagccaaaaaaaggatcttagtccaagatatgtacgcgatcgagacactggcccatgtcgataccctctgtttagacaaaaccggcacattaacggaaggtcgattatccgtcgaatcgatccagccaatcgatgacacccaagatataacggcaatcttaggtagttatttggctgccagtaccgacaacaatgtgacgatgcaagcgttgcgccaaaccatcaccggatctgatcattaccagtcctttgcagcgatgccgttttcttctgatcgaaaatggggtgctatcgcatttcacgaattaggggcagtctatctaggagcacctgaaaagacgatcgccaaccaacagctgccgcaaattcaagaagcgcaatcggctggtttaagagtcctcgtcttgactcttgatcctcattataacgacgccaatcagccctttgatccagcaaaggctgccccgctggcagttcttgttcttgctgatgtgattcgggaaaatgcagaaagcacattggcctacctgtctgcagaaggagtggacttgaaagtgatctcgggtgacaatccgatcactgttgcagccatcgccaaacgcgccggattgcctaattcagagaactatatcgatctttcccaactaactgaagaagcagacgttcgtcaagctgcccaaacctataccgtttttgggcgagtgacgcctcagcaaaagaaactgctagtttctgagttgaaggcactaggcaatacggtcgccatgactggagacggcgtcaatgacgtgttggcactgcgtgaagccgatgtcagtatcgctatggctgctggggacagtgcggctcgtaaaatcgcgaatctggttttattagattccgattttacgacactgccagcagcactctttgaaggtcgccgtgtcgttaataatgtgacgaaagtatctgggatcttttttatcaaaacgatctacagtttcctattgtccttactatgtgttgccacttctacggcatttccttttattccgatccaaatcacattattggacctagcaattgaaggatatccttccttcttcctttcctttgaagaagacaaaaagcgaatcaccggccgttacttgcctaccgcattgctgcgagcgttgccgagcgcactcttggtgcttctgaattatttcgctgtacagttcctgcaaactgactatggctgggaaccaatgaccgcaactacattgttctattatctgctgatcggcatcagttgtttagctgtgatccgcagctgtttgccgctaaatccattgcgcttatttttgatcgtaaccacgattagcggaacatacatcgccgcaatgctcttccatcacattttagaagtaggctttttgactagcatcaccttgccaatctttgttggattgatggcgatcaactgcttattgcagtgggggctatctgcccttgcaacacagatcacccgccggctagagcaaaacgctacggcttgatcctttcaataaaataaatccgaacaacgatgatcccttctcctgattaagatacttatcaacggttgttcggatttttgttgtttccgctcataaaatctttattaactttctgtctttccttagtagaaaaggcgactagcaatttcagttcttcaactttgatatccatgttcaaaatacttttgactatcagcaaaataggtctcaatcaagggatccattttgcataggagtgctttggctaaggtaaatagaggctcaagattattctcttttttacaaatcaatagatagctagtcgctaattcactgcttggaacaactaaccctactgcttgacacatattcacaacccgaatatacccttttcctgcttgctgttgtattcccattgtccgttcatcaaaatgaccgaaaacagtatccccgatgccaaacaagtcaatgggtccttctttgacaacaatcacatcgaaatcaatgagcattgcctgtaactgttgaatcaatgtttctcgagaaaaggtcgttgcatcttcaaaggttttgtacatgcattcgatggtagaaatattagaaagttcttggcgcatcttcacgtcaattctattatcgaccactacccttcttttaggtgtctgcttaaacatttggggtaagcaaaggtgacaaagctgttcaatcagtgagagctttttactaataaaccctagcgagggtgtaaatgaaatattatccgttgatgtttttctatttacagatagatcaacaaattgatttccaagatcaggatggataaatcctaccaaatttaaggcagacgcaggagctagaacggatccgcccccatcagtgcccaatccaacatcgttgattcctagaaaaacattcaatgctgtgccactagatgatcctgacataaagcgaccagtaatggggttcttcaaatcaagatcaatccctctgccgctaaaacttgctttgtctaatgtgtgttgatgaaatccgttgcttgataaaaacgttaaaaagtcagtcaacataaatgatacttgcttcactcctagataatagtcattgagtgtattgatctgcttgatcgcattgggataaacagttactactgaaccacttggatttaacatgcccaaactagtttttagcgcatacttttgtaccctttcatgcatccttatacctccttcctaaaaaagacttggcatagctttttatgaaaacaagcacccaagtcttttttatcaatcaaaaatttcttttaaaaaggagtcaccattttgtggtgctgccaccttaaaatagtcagcaaccgttgctcctacatccgctaaggtcagccgctcaccaatttttttcccttgcacccccgggctataaattaatagcgggacgcgctcacgagtatgattgctgtgtccaatcgttgggtcattgccatgatcagccatcacaatcaatagatctccttctcgcatctcaagtaacaattcgccaattctacgatcacttacttccaaacgatctgcatacttctcagtatcctccgcatgccccgctaaatcggtttcttgaatattcaaagcaataaatccgtgatcaattgtttttacttcactcatcaaattatcaaacaatccttcagaatcaaccccgggaaatagtcgatgactttccgtttgaataatatcagcaatttttcctaggaaagataccgtgattcctgctttatccaagatggtcggtgtttggacatttttgtcaatcccataccccaagtgaacgacttgatagccatgattgtaaacacctgattcaggagcatccactccagcaatctcatcatttttcacttttttggctgataataagtcatctaaaacaatctgttctccaccaaaagtgatcacacgagagacttgaacaacgtctctaaccgcttgtcctattttttttaagttagtaaaatcaactaaatccagacaagccgatacattatagacttgtccataatcagtttccaagttatcgccgactgttgccacctcgttgaccactaagatttgagtccctttctcaccaactcgccgcacttgatacccttgtttcactaaattctcttccactacatcaatcttttggttgaatggctgaatcaaagggatttttggtgtcgttcccataatttcctgatgtcctaaaaaagaatccgcaccatagtgagccaaattactcgttccataatttgctgttttagaaaaatgatgacgtccaatttcctcccctaaagcattcattaagcctaatttttccaaggttggtatttgaatattcggtatgtctcgaataatatgtccagctgtcgtactgccaatatcacgtggccgtacctcctgtacatcattcatagcaccaacaccaaaactatctaatacaataacgacaaatctccccatattctcaccttctaatttgttttccaagactgtcatatattccttcaattctaggttgtccagtttgaatccctgacactacagcaacatcacttctagtaacaaatatttgagtgcgaaatgccgcaagtactgttgcaccaacttcatgtgggagtttagttgaaagataataatcaatactatcattaccaaaaggtataacttcatcttttgctagcttctggtcgtcagtagaaatcattacgctttctaaatgccctcgccgataataaccgcccccataaaaataaccgtgaccatctaagttatgagaaatctcgctgacatacaatattgctggtttttctggcaattctagttgagcatgtaagggggtcgtccctgttaaagcatgccccggttccccttgtgtccctcctaactcatggataaaaggaattgttcgactacaagtagcagaaggcatatttacttcttttattgcgaaaccagcctgtttaagaatggttattgctttcttaattgtttcaacattgtgcgttggttgtaactcagaaacgccatcaaaaagaaaacaaggaaaggaagtaatccccccaacgataattccttcctgttttactatttcaatgaccttcgttaattcatttagatgaaatcctccaaattgtccctcataaatttcgtcgcctggttcaatcactttgagtagtattttttgctggattcctaactccctggcaacagtcgcgatattattgatcatttcagttgaaaaaacagtgatatagtctgtaccataatccataattttctttagcaagtgtttgggaatttgcacaagatgaccgacattccctaaaggcaagccttgtttcatcatcactaaagcttccttgtaatccaccaccacaacttttttaatacctgcctcatgaattttctgtgcgacataagggtttcgcccaaactgttttgtcataaagaacagttcgatttgattttttgtagcgctttccactaaaagccgagtattgttttcgatagcatcaagatctagcacatacgtatctggaagaatttgtcctgtttgatgcaatcttaatccggcttctactaactgcggatttttgcgcatcgttacatctaagaacatattactcctcccttaacatattaatgatatgcagataaaaataatctaactccgcatccgcgaatgactgttcacttgtcattttttgtaagtcttgccacaattctctagaatgaagataatgcggatcaccttcaatctctgcttggatgaaagactctaagctgttgacagtttcattattttttcttcgcatatctgccatcgctaagtgggtcaaaaaaacatcagcttgttgctcttcttcaacaatttctttttctaataaataggataaaacgttaaatacataatcgtacgtttcctgatcaacaatccccgaatctaataaaacagttaatttatctcttatcatgaataagcccccttactaatattgcggaattaattgtccttggcaaactgcttgttgaatttgcagtactttctctttattgatgcttttttgtaggaaggctttcattgaaacatcttcaatatgcgtaatgattaccgaagtccccatcgctttttctaactgattttcttttaaggacacatactgtaacccttgctgatttttatccctaatttcatcaaagttccatatcccagcatcaatgtgatcatccttaagcgcagagatgatttgatgtccttgcatctcaataaattctacaggtaagtcaccaattatttcctttgttagtgcctgttgatctaatgagctgtagtcgatggcaattctcatacctgatgtaagaacagtttgtccctcttctttaaacaacaagacgtgctcgcttaaatatgtctgtgtcccaaaattaacaactatttctaaaggctctccttgtttaattgctcgttgagcagcaaatgctgaaacaactgcaaaacgatacgttttatttgtaattgagcggattctttctttggaacctcgaatgtatgccatattaagtttgatattattctctttaaagacttcgtaaattcctgttgctagcccttcatacaatcgtgaatagggtaacgtcattgttcctaaaatcgtatccgataaagcgtattcttgtaatactccataatcaatggcttcaataaaggttcctaaatgcccatgactttttaattgaactgcctttatctcttttagaaaggttagcgcattttggatcgtccctctcgcaacatcgaagcgagtctgatattcgctaacactaggtacacgatcccctttttttaattgtaaaagatcggatgctagaaagttaatgacaattccttttttctttaaaaactcttcccccatgatttctccttatcttgaggctcgttttacagatgcttgcaagatacgcataatggtatccgtgccagatcgattcgggtttattcggatcattgttgtctcagcttctggatcagattgcttgaaggtacccgaaacgcgataaactaaaggtgcaaactcgtattgtgactctgcaccgactggatgaggcaaagcccctaacttggttgcttctgtaataatcgcctgtgctattggttcctttaattttactacaacaactttagattgcgcattgacaatataggcttttttaaattctgcgatttcgccttcgttgattcttctacaaactgcttcacttacctcagcggagattgctaaagctactggtgcataaatcattcctttaactacatccaatgcctcatgcccttgtacctgtccaccaccagaataattttcttctcgtaatttactaatgtattctttctcaccaacaatgcatccaataccttccggaccaagcaatttaaatgttgaaaaacaggctaaggtgccacctaattgagaacctatagcttttgtctttaaagccgcataattatcatctgtaataattggaattagtggattcaccctacgaatagtggcaatcagttgtgctaagtcatatgaatctgaaattttttgcctcgtgacttggattagaactccatcaacttgcctttcatttaaggcctgtgtcacactcgtctgatcattaaagtcagcatgaattgtctggattcccaacatctcaattgaaactttcgtagtaggataaatgggggcatcatgcactaacaacgttttaccagttcctactgcagcatggagggctagtcgaatagcatttgtaccagatccgcgaacgagcatagcttgttctgattcaaaaaaattagccaatacttgctcaatctggtaggtagtttttggttgatttagtccttttactacaccaagatcccctcttgttaatagttcatccccaggtacaattcgtgtaatggcatcaacaagcttaaattgtaattgttgtgcttctgtcaccgttagactggttaaaggataagctttcatgatcaatatctcctaatcatccataaattttttgggatttattcgtagcattcggtcaataaatgtctgagaaacaccattttctaaagccatcggaacaaaggtatccaaaagataagaataccctataccaccttgataagacagatttgatttacgcgtgatatccattgaaaggaagactttatcttgatagccacgtttctctatttctttcagcatttcaattcttaataaatctggctgatagttttcttttccgatcgtatcaaattcaacataaacaccttcgtctagcatttttagaatatagtctgtgctgccacttagatcaacatggccgataactatttttgacaaatccgcctgttgttccttgaaaaaagctacctgctcatgcccgtatgtgcctaatgttgtatgtgtcgtaatcgggatcttagtctgttgttgggcaatgacagcagcggtaaatatttttcgttctcgatctgtcatcctgtccttgctcgtaccgatttcccctataatccctgctttgatcgttgtttccgcaattccttcttcgatttctttgatcattaatgaggacaattgatcaatcgatgcttctgtcacaaagctaggtaaaaatttatcctgataaaaacctgttgcctgaataatatttattccagtttgttcagccactttttgaacatataaaggatttcttcgcatatcaagattcgttacatcaacgatatttcgaacacctttatcgtacaaatttttgtattctgaaacagtttcatcaaagcaatttaaatttgtatcatcactcttttttaatcgagataaatcaatcgttgtgtgttcatgcatatatgtgataccttcaagaatcatgtacagctacctcctagttcgctacaactggtgcaaataatccaaccagataaaggatgtttacaattacacctaaactaattgccgcaattggaccaacagccaattcaaccactggtttcttcgcttttctattcaataacattaaaccaatgacccagaaataaccgattcccggcgcaatttgttcagatgccatagcgcccccaatcagtagtgctacttctaaaaccttattcattgccgttcgaatatgctcacccatttcacgaatacccggaaacttatccagggcttttgccatcaaactcaacaattgtacttcaataaacattaaagctgaacctacgataaaagccattattggattatcatgcaataaaataccagctacaaatacaaaggtcgtaccagctggactataaactcccgttacgattgcagttgaaaacaccaacggaataaatccaatgcctcgagcgaaggcagctaatccagcctcactaaattttccttccgaaagtaaatttaaagaaattggatctccggcaataatcattaaactagttgctgctgagactaagccaccggtcactgctaaccatgcccaattttttttaatacggttaacacgttctaaaaaaacactgacaagactttcatttgagttgcttccatcacttttgacctgaatggcgtacacaatcatgaaaatcataccaaccagtaatgacattccctccgcactcagtgttaaggaagttccattacctaaatcaaacgtaccaaagcgcttcactgcaaataaagttaataatgtggctgcaaaagaaatagctccttttttaaatccatgctgactagcaattgcgacagctggaaaaatgctaaaagaaataacaactggtgtccctaccatagacaaagaatccatgaaattcacgggcatcattgcaaataaatcaactaccgcctgcaatcctagaacaagaccaattccatacatagcgcctataattgccgaaatgatgataccagacttgccttctggcgcccaggatccgatgatatccgtcattaataaaacactatgaaccagtaaaatagatgccccgatggatactggaataccaaaaccaataactagaccaaaactcaatgcaaagctcgtagcagcaatttcttttttcccaatctttccttctaaaaattcaggaacaattggtcgtaatccatcgttaaatactgcgatacctttatttgccaacactgcacatattccacctaacaacgcgattgcaactaactcaataatttttgatgaatccatcttctttcctccgctagattatagtttttttcaactcatccatgatgatcggtataaccgtttctttatgctgagctgtaaagccaaaggcagttttacctgattgtacattctcacggatttctgcttcaggcattacatttcccggcattgaaacagttacacaattttctcttcctaatagtgctaaagccattgctaatgccccgcctccaccagtattacaagcacctacataataatctgcctgcccagactttactgccatagccgcatctaagtcacttttaatgtcaatttcaaattgcccctcactaaatttttctaccaagtccttcacttcatttttatcaatctgaccgccaataacaatttttttcatagaaatcctccattcccaatatacatttttttgtacattgaataacaaaataatgattacacttggattgtaatcggtaacaaactcaaatgcaagtactttttttaaatccctataaaatttaggcaaaaagaaaagatgcataggagtaattttctatttataaacaactatttaatcgattgatcttcttaccgttgctcaattcctctttcacgagttgttgttgatcgttaaaaacaaatttagcttgttgtttgttttgccccctctcaatcgtcatccatgcaagttttgcgaaatttgttatacttttagtgaaggcggtttcgtctactgccgctgaatctatttaagaaagcgttggtgaatcgaaatgaagaaaagtattttacttgtttctcacagtcaacaactgacagacggactgaaagccatgatcgaagacatgtcggacagcgaaacagtcactcttttttcattgggtggaacagctgaaggcgaattagggtctgatccgacaaaaatcgttgaagcggtcaatcagtctccggatgccgaacagattctcgtttttgctgatttgggtagtgccgtactaaacgcagagctagcctatgatatgttggaaccggaacagcaaacccgctatcacttgattgatgcaccgcttgtagaaggtgcttttgccgcagcaatcaccgctggattcagtgatgacctatcccagatcacagcagaagcccaaaaagcagctgagaaaggatggaaacaataatgaaaaaaataatcaatgatccttcagcgatcgtcgaagaaatgctagctggtctggttgccagctatccgcaactggttcatcaagtcgaagactcccgagtcgtagcaaaaaacaccacccacgaacaagttggcttagtctcaggcggaggcagcggacacgaaccggcacacgctgggtttgttggtgatggtatgttgagtgccgccgtcttgggagacgtcttcacttctccaacaccagatcagatcctgactgggatcaaagaagccgatcaagggcaaggcgtgcttttgatcgttaaaaactatacgggagatatcctaaactttgaaatggccaaagatatggctgagatggaagacatcactgctgaaatcgtcgtcgtagatgatgatattgccgtcgagaacagtacctatactgctggaaaacgaggcgtggctggaaccattctcgttcataagattttgggtgcttttgctcgtcaaggacgttcattaactgaattaaaagaattaggtgaagcattagttccgaccatcaaaaccattggtgttgccttaaaagcagcaaccgttccagaagtgggtaaacctggttttgaattagcagatgatgaaatcgagtatggcgtgggaatccatggagaacctggttatcgccgggaaaaattgaaaccatcgaaagagctagccaaggaattggtggacaaaattttagctgattatgaacaaacaccgaaaaaagttggtgtcttgatcaacggcatgggtggtacaccgctgatggaacaattcgtctttgccaacgatgtacagaaattgctcgcagacaaagacatttctgtcacattccataaagtcggcaactatatgacctctatcgatatgcaaggtctatcattgaccatgatcgatttcagtaacaacgatgcgacggatgcgctcaacgaacctgttgaaacgattgcttggtaaaggaggaattttcaatgcaaatgacaacagagatgacccaacaatggttaaatgcatttacaaaagccattgaggaaaataaaggctatttaagtgatctagatacccctattggtgacggcgatcacggcaacaatatggctcgcggcgtcgcagcctatcaagaagcattcgcaaaacaacagcctaaaacaatcacagacacattcaaagtactctcgatggcattgatctctaaagttggtggtgcttcaggtccactttatggctcagcattcatgaacatgaccaaagctacaaaagaactagaaacaattgattcgtatgaacaattaggaagcatcatcgaagaagggcttaatgggatcaaagctcgaggcaaagcagaattcgaagacaaaacgatggtcgatgtctggcaacctgttgccgcagcgttaaaaaacggcagtctgactaaagaacaaatcgaggaagccaaagaacatacaaaagacctagtcgctaaaaaaggccgtgcttcttatttaggcgagcgggcaatcggacatatcgatccaggtgccgcttccagtgcattgttgtttgaaacgcttgttgcaacgattggataaagatcctcattccacttaggaaaggcgatacaaaaaaccgagagatctcttgcgattcttgaagataaacaagaatctgtgcttgagacctctcggttagtttatttttctaagaaatagtcaacgccattattgcaaaatagcttgagaaactagtgtacaatattgcaacataccatcaggatttggatgaactcgatcttcatagaaccactcttcatgttcattacttaaatcataccaatcgatcaatgtcatattgtcgtatttagcagccattttctccagcatgctgttgacctcattttgccatctttgcgtaggtacccgcacattgatccaatagactttgcgatcgccaatttctttcatcaaattatcgaattgggtttctgtaaaggacccattcgttcctagaccgatcaataccgtatctcgtaacaaatctttttctttcaacgctttgatcagttccggactctcatacaattgtcgtcccacatccccatcaacgacagctttgggaaaaatttcttgcaagtcggcagtggcatccagcataacagaatcaccaaaagcggtaatttccagctcttcagccttcttcacctgggcttctgtcaacccatatttttccattactgattgttcggcttccgttgcctttgaagaattgtctcctgtactttctgtatccgagccattcgcatttttttgtgtctgttctgccgcttttttattggcagcaatattttcttttaactgctgctgttgcgcatctacataattcaccggagcggtagctattccataaagagcaactaaggaaacaagcagtcctggaagcagccaaggtttttgtcgactgatcactggtttactaaaccaattgcgcaccgtgcggaaagtatctttgtagtggaatttccgcaacggattttcgataaaccgataggacaattcactgatcaagagaatcaatacaatctcaatcaatgtatgcaggagaacattttcgccgacattcccaatctttgcttcataaaaaatcatcacagggaactgatacaaataaatcccataactccgcttgccgatgtaactgaataacggatttgtcagccaacggttcagactagctccaggatgggcagtgaccgccaccaagatcgtacaaagcaagctgactagcagcattcctccgtaataaacaaaggaaagatgatcatctagcacaaaaaatgttatcactaaaccaataaaagaaagaccaccagctaggttcaatacccgcttcgctttcttcggaatttctttttttaaatgggtgctgggccaaatgaaagccagcgcacttcccatccaaatcgaaaacaaacgcgtgtcggtaccataataaactcgagtagggtctgcccctggtgaataccagatcgctaataaaagagccgaaagtaacgagcagccgatcacgattttaaaaatcgtcccacgatttttgactaacttcatcaataaaataaagagtaacggccaaatcaaataattctgtccttcaacagccaaagaccatagatgcgtaaagggagattcattgccgaatcggtcaaaataagaaagaccgtgattgatctgccaccagttgttgacatacaagagactgctgacgacgactccccgcagattattcagtaaattccgctggaacaatgtaatataggcagcagacagaagcagcatcaccaccatgccaggatacagtcgtttcatccggcggacataaaaatctttgacagcaatacgaccgttctggtcccactcctgtcgaagcaaatcggtgatcaaataaccagaaactacaaaaaaaacaggaactcctaaatacccgcctcgcatttgagtaggtaataaatgatataagataacgccgatcacggctaatgtacggataccgtcgaaaccagtgatatagcggcttgtttttaaccgtttgttcattctccaaccacttttcttttttttgatcaactgttttcgtaagaaacagtcaatgtggaaccattaaaaaataatgacccatttcttcataatttaccagataaagcaacaagaaagctagcaagaatactctattttctaaaaaaattaatttttacaaaaagaaaaaagcatttcatcacgaaacgctttgatccaagctctcctataattcttcttcataaaaacgacccaatatttgtacattttcagcaatactgacaaatgccttgggatctgcttctttcatggcagaacgtaacatcggcaactcgaagcgtgtaacgacagtcaataatactgtctgtttatcatgcttgtaggctccttctgcttcattgatgatcgtaattcctcggcgcagacttttctggatcgtatggatgacttcttcaggaattctcgtaataatcgttacctgcattttcttttgcttggtaaaaacagcatcggtgactttaccactgacaaaaatcgcaatggcactatatagcgcatactgccagccgaacaggatgcccgcagcaaacatgatggcaatattgaaaaaaatcgagatggacccgatggttttccccgtacgtttccggatcgcgatacttacaaaatcgaggccgccagaggaaagtccgctttttagcgcataaccaataccggctccgttgatggctcccccaaaaatcccacagatcatcggatctgtcgtcagtgtttcttctggaagaatctgtacgaacaaagatgttaggactacagtaattcctgtgaaaatcgtaaatttatgaccaatcttgaaccagccgagaaagaaaagcggaatattcagcaacaatagggcgactgagacggggatatagaatccaagccaatccgtggaaacggtggtcaaaatttgagctatccctgtgatcccgctagaatagattttgccgggttgataaaaaaaattgactgcgatcgccgataaaatggcgtagacgatcgaaaacgataatttgttggcataatcagggtgtggcagccatttaaagagggtattcatttcattcaagagcctcgctttgttgatttgctcttattatacttcagatagtaaaaaaagaaacgaacaatgaaagaaatagacaaattctcatggaattttcttaatcgtctattttcattcatcattcgctcgtttgttctttacttgttcatttctttttacttagtcttcttcaactgtcgtgacatcaatattcaattcgaacaattgcagcggcgccactttacttggcgcttgtgacattggatcggcggctttcccgtttttagggaatgcgatcacttcacggatgttttcttcaccagccagcaacatcactaaacgatccaagcctagtgcgattccgccatgtggtgggaacccatagtctaatgccgtcagcaagaaaccaaattgttcttccatttcacggcgagaaaaaccaagggtttcaaacatttgttcttgaacatcccgctgatggatccggagagacccaccgccaagctcgtaaccgttcaagacgatatcataagcttccgcatacacttttgcaggatcagttgccaacaatggtacatctttttctttaggcatcgtaaatggatggtgagcagagacatagcggccagcttctgcatcgtattcaaattgtggccaatctgttacccataagaaattgaacttgctttcatcgatcaagcctaattcttttcctaacttgctgcggattgctcctaaagccgccgaaacgatctcaaacttatccgcaccaaacattaggatatcgcccacttctgcattcgtagcagcaatgatcgatgctgcagcgtcagtcaagaattttgcgattggtccttttaagccatcttcttctactttgacccatgctaaccctttcgcaccaaactgtcctgcgtaatgtcccaaattatccatatcttttcgggaatatttatccgcagcacctttcgcattcaatgctttcaccacaccgccattttcaagcgccatttggaaaactttgaaatcaacatctttaacggtttcggacaaatcaatcaattccatgtcaaaccgagtatctggcttgtcgctgccataacgtgccatggcatcatcgtaagtcattcgcagaaacggcgtagttacttctagccctttgacttcacgcatgacattgactaacagttcctccgtgtaagcttgaatctcttccgccgtcaaaaaggttgtttcaatatcgacttgggtaaattcaggctgacggtctccccgcaagtcttcatcccggaagcaacggacgatttgatagtaacgatcgaatccagcacccatcaataattgtttgaaaatttgtggcgattgtggcaatgcataaaaatgaccagggtaaacccgggaaggaacgagataatctctggcgccttctggtgttgatttcgctaaataaggggtttcgatatctagaaagtcattggtatccaagaaatgacgaatcacttgtgtcgtttttgcccgcatcatgatattcttagtcattttgggacggcgtaaatccaaataacgatatttcaaccgcgtttcgtctcctacgatttgatcatcttcgatcgaaaatgcaggtgttttggctgtattcaaaatagtgatctcgctgaccatcacttcatagtgcccggttttcatcttaggattgattgcttccggtgctcgattgatgacttgacctgtcacttctagcacatactcgctgcggcaagtatctgcaatcgcccatgcttctttggatacttccggattaaagacaacttgcacgatcccttctctgtcccgcaaatcaatgaaaatcactccgcctaagtcacgacgtttttggacccagccttttaaagtaacggtttgatctaaatgggcttctgagacgcgcccacaatatactgtacgtttgctcattcttcttctccttgcttgattaagattgtagtcatttcatcatagatttcatcaaaatgatcatacagatcggctaacttaaattgtttctcgatccggcttgccatcgatttgatgttgatcacttgttcagctaattcattttcacctagggtcagcaccaaacgcgccccttgcttatctgccgatttgaactgcgcttttgctttccgattcataaaatcacgatctgccgaaaagccaaaattacggatcgcctgaacgactttcaatgcttccaaattggttgcttctcctagaccaacaacataagcatctaattcgttcaatgctggaataacgacttcttctgcttccattgtgatcaatagacgttctaagcccatcgcaaaaccgaaacctggcgtttgtgggccgcctaattcttcgaccagatggtcatagcgtccacccgcacagatcgtagcttgcgcccccatttttggcgcttcactcataatctcaaaaatagtatgggtataataatccagtccccggaccatatttgaatcaatctcataaggaatgtccaaagcatccaacatcgtgatgactgtttcaaaatgggctttagcttccggacttaaatagtccaagatcgaaggagcatccgcaacgaactgttgatctcgtttgtctttactatctaaaacccgcagtggattctcatgcagacgacgttttgaatcttcacttaattctgcttcatgaggcgataaataatcaatcagtgcttgacgatagttcttacgcgtttctttatcccctaaagagttaatcactaatcgaagttgacttagccctaattgtttaaagaaatccatcgccatcgccatcgtttcaacatctgtcgcaggatttgcggaaccaaatgcttctacaccgatttgatggaattgacgtaagcgacctttttgcggccgttcatagcggaacatcggtccaatataaaagactttgtaaggcttgttgtattcaggtccgaaaagtttattttcaacataagaacgagcaatcggcgctgtgccttccggacgcaatgtcacatggcgctctcctttgtcatagaaatcgtacatttcttttgaaacgatgtcggttgtatcaccaacgcttctagcaatcacttcaaaatgttcaaaaatcggtgtgcggatttcattgtactggtaatcacgaaaaaccaaacgggctgtttcttcaacaaactgccatttttcggattctcctggtaaaatatcattggtgccttttggacgttgataactcatctgttttcatcctcctattgtgggtatcttcgatcgatcaaaaacgatcgtatgtattcattacaactatactgatttgatccattgtgggaaacgattttctgttcatcatctgctcgtctactctgcgttacgcctaccgtcgcttctaagctgtcgctaagaaggacttgcatagtcttcgaccagtcgcagtgattcgaaaagtggtgactactctcccttcggtcgcctactactgttcatcatctgctcgtctactctgcgttacgcctaccgtcgcttctaagcttacgctaagaaggacttgcatagtcttcgaccagtcgcagtgattcggaaagcggtgactactctccctccggtcgcctactactgttcatcatctgctctgccctgcttcgcaggtcaatcgcagtgattcgaaaagcggtgactactctccctccggtcgcctactactgttcatcatctgctctgccctgcttcgcagggcaatcgcagtgattcacagcaaaaaactcgcccttgttttctacacaagggcgagttattacacgcggtaccacctaaaattcgagaactttcattctcctttcgattaacgctcgttcacggaacagcttttcttctgttcatctccagattgtctttccgacatttgtcctaaactgcttgcagccatggcagttttctctttgaaggtccaataatgacgtactcgatctttcacagatttttgatattatctataaactacaagaatcctttggaaatgtcaagctgtttcataggctttttcaatacttatgaatatcgtttttcaagtttttcctttacactaaaagaagagattagaaggaggaattgctttatgacagatgttcaaatcggcaaatcacaagtctatgtacgctcccttggcttaggtgcaaatgccatcggcggccacaatttatttccaaatttagatgaagaagaaggcaaggaaattgtgcggacggcgctgcgcaatgggatcaatttgattgatactgcctatatttacggtgaaggtcgatcagaagaactgatcggtgatgtcttgcaagaagaagcgttcgatcgcaatcaagtcatcattgccactaaagcagctcatcgaccagaagaaccaaacaaaaaagataattcgccggaattcctgacccaagccgttgaagaagctttaacacgcttaaaaaccaactatctggatatattttatattcattttccagatgaaaccacccctaaagaagaagcgattcgcgcattgcatcaactgaaagaagctggcaaaatccgtgcgatcggtgtctccaacttcacacttgaacaattaaaagaagccaatgccgaagggtacgttgatgttgtggaagatgagtacagtttgatccatcgccaagctgaatcagaacttttcccttatttagctgaacattcaatcaattttattccgtactttccactagcatccgggttgttgactggaaagtacacacaagaaacgaccttttcaaacgacgatatccgtagtaaaaagccggactttcaaggtgatcgctttaaaaaaatcgtatcggctgtcgaccaattgcgaccaatcgctgcctcttatgatgcaacgattcctcaacttgtgttggcttggtacatgaaaaatcctgcagttgcagcagttattccaggtgcaaaacaagccagtcaagttgctgacaacgcgcaggcattggatatccatttatccgcaaccgattatcaagcgattgatcacctgtttgctgaatttaaatagtcccgaaacaagagaaggcactttgcatttctcttgttttgtattatgctgatgaaaacagttatgaaaaggagcaaccctgatgtccttatattccggctatatccgccaacctcattactatgaaaccgatcagatggcaatcattcaccatgcaaattacatccgttggttcgaagaagcacgagtagatatgctcgcctttttacaattgccataccataaaatcgaagaagcgggtttgattgttcccgttcttgaagtcaatgcacaatacaaggaaatgatccgttatgaggatcaagtacgcatcgatgtgctcgtcgatcattacaccggtactcgacttgattttcgttatgagatttatagaactgacaacaatcagttagtcacaactggcgcttccaaacattgttttttgagtaaagagacctatcgcctagtccatttgaagcgcagctttcctgagatccatcaagtattttcagattatgcgacattatcggctgcctcgaaaaattaatctcgagacagattaattgcatttagagcacttttttgtataatcaaaggtaatttttatgggaggatgatgacaatgtatgttgttaaagtcttgcatggttacattggcaaagatggtcgtcgcactcgtgaaaaaatacctgacaagttgtggatttttgaagatcggaagcagtcggaagcctttgcagcaaaaataggcggaagagtcaaacctctcacagaagtaaagccaaatcaataaaaagcaagacagcgaaagaacgcttactggcgtaagtttcattattcgctgccttgctttttttattgcttatcgcttttgctagtcatcttgttcaatttctaaaatttctcctgtttgcgcattgattttaacatttgtttttttgttgccgtcttcaactttgacttcccaataagtcacattcatttctttatcaagatcccaatctgttgcttgtccaccgccagcttctttcacagcactatcggaaatctcttccaatgaaagcaagttggtcagatccaattgatcggcttcttttttgacaccgttttgttcgtccgcatctagtttttcggttctttcttcagaagtttcttttgtttctgcatcgatctttagttcaaattcattcgtgtcgtctacgccttcaacttgatagaagtacttaccaaaagaagtatccaagtcaagcgatgtgattgctgcatctggatatttgttttggaacacttggacggcttcttctactgtcactgtaggcaaaccgccatttgcgatggctgcactgcttgaagatctgtccacagcttgcgaagaagttgtttcatttgatgatgcgactgctgagcttgaactgctgttttgtgcaggttcagaatttccagtgttattttgtgtacatcctgccaataatcctagggcagcgattccgaacaaaattgttgtttttttcatgtttcatttctccaattaattgtctattccttttttctatatatttagaataacaagtccttcagaaaaaagaatcaaaaatgcttgaagaaaatctaaaaaaatcttcatctttctctttcacttgggaaatcaattttaaagacactgccttgcggctgattatccgtgacggtaatttcagcatgatacttgttggccagctgctttaccagtgataatccgattcctgaaccggaaatttgactggaacgagaatcttccactcgatagaaacgctcaaaaatcaacgctttcttatcattggggatcccaataccaaagtcggcaacggttagagacaagtgcgtttgatcttgtgtcagtctcacatgaatgggctgatctgctggtgaatacttcgctgcattttctaaaagattttggatgatctgttggaagtcacgtttgtgcccttgcttcctacactggttttccacaaaatattcaatcgattgcggaacgatcgttgcttgtttttcacattcttctcgcacgatctgcgagacatcaacgagacttatttcttgggtttggtttttttccaaatccagcagttgattactcaatgtttccaaacgcttcgattctttatcgataaaggccagtgaagaaggaatgacttctgggtgtttggttccacgccgctggatcaattggacatgtccgcgaatcgcggctaaaggtgtccgcagctcatgagaagcatcggcaacaaaccgtttttctcgcgcgatcgtctcacgctgttctttcagtagtttattgaaagccaacgccacagaacgaatctcgattggttcttcaacaatcgtcaattcgcctttttggctttgttcgatttcagcaatttcttgcgccatccctgttaatttccggctccatttcccaacgctccaataaatcaatatactgccaacgactacagcgatcaggttcaagaaactgctgatcataaagagaccataggctaattccacactgtcctcaccattgatggcgatcttcacctgatccctatcgatttcttgggttttcgtataatagataccatcatctgtaaagacgatgccctccaaaaatgggatgatccgtccttgattgatctcggcaaaaatctctgctgcatcttctgataaaatgacactgccatcagctaagatcacttgcaaggcatcttcttcatctgccgaaacataggcattgactagatcattccagtcatcccctgaagcttccccgctttcgatagcctcaagaatattgctcgcacgattttcgatatgttcaaacaaataccctacggataacaagataaacaatacattgaagagaatcaacagaccaaatagaatcaaagaaaagcggctcgttaattgaaactgggcagtttttctgcgtgggttggctaacttattcttcatgggcggtcctcaacacatagcctaatccccgaacagttgcgatcattttccctttaccgcagacatccagcttgttgcgaagggtgcgaatataaacatctaccacatttgtttgaccatcgtattcatacccccaaatctcattcaatagctcatctctggttttgactacttctggttctttcatcaactcatataagattccaaactctttaggagtcaattcaatggtctctccggcaacctggaccaagtgtttggcgatgtccatcatcaactcgcctaccaccaactgattttgttggttcttttgctgttgggcttcccgctgcaaccgtcgctcaatcacgcgaatccgggcaaacagttcttcgatttcaaagggcttcgttaaataatcatctaggccaacgtcaagaccagtcacgacatcggcagtttgatttctggctgtcatcatcaaaatcggaatatcgctttctttgcgaattcgccgcgccaccgtgatgccatcatagattggcagcatccaatccaacaaaatcagatcaaacagatcagtttgctgattgaacaaggtcaatgcctcttggccatctttggcccataccgtgtcgtacccctcaaaagtcaactcagtctggataaaactggctaaactttcttcgtcttccactatcaagattctcaaggccatctgctctcctcctatttttgcttctatcataacggattttgtaaaaacttcctaacggattgaaagaaaaagatcatgaagattttttcatgttcagacaaaaacggagtgaaccaatgctcactccgcttttcttttatcccccatttgtcgctaactgataggtatcaactaactttccctgttcgagttggatcacgtaagggcaggtttcatccaaaaactctttatcatgactgatcacggctaacagatcgacttctttggcaacttcctgcagcagatttccgacctcttccatttgtttcaggtctaatccgctagtcggttcatcgaaaaacaacaagcgtttacctgaaagcaatgcactgccgatcgcgactcgctgcttttcgccaccggacaaagattgtggatgtcttcgcagtaaatgctctagttccaacaaagtcacgacttgttcaaaacgttccggtctggcagcttttgccaacaattctttttcgacagattcaaaaaaaagctgcaggttcacatcttgcataaccagaaaactttctcgcaataactgtttttgattgattggttgaccatgcagccaaaattgagctgctgaacatttttttaagccagcgaacacttgaaacaatgtcgatttgccagcaccgttcgggccaatcaaacccacgacttgtcgcgtaggcacaacaagtttcgcaatatcaagagctggttgctgttggcgtcgataagtgacttggagattcgtcgcaatcagatcagctgagaaactcgctccctctgtttcgttgattgccaactcgaactgcggctcgttgatccgccttaatccgagattgtgaatctgttgcggggtatgagaaagcaatgcttcactggtatactctgtgaccaagcgcccttctgctagtaataagtaacgatccgcaatccccgtcaagtaggacaatcggtgctctgcaatgacgatcgtcttcccttgctctttcaaaaggcggatcgctgcggcaattttttgtagtgcttcttcatcaagattactggaaggttcatcgaacaaaaagagatcatgagaaagcatcgttgcacaagcgattgctactcgctgcttttcgccaccagacagttcgaaaacacttgcatccaacaattctgacaaagaaaattgttctgccgcttctttgatccgttttcgtatttctactggctctatccctgcattttccattgtaaacgccagttcagaataaacatctgttgtaaaaaattgtgttttgggattttgaaaaacaacaccgatttttctggcgtaggcgggaaagtcttccgtcggcaaagaatcccctgccacttgaacagcccccgtcatttctgctggatatagttcaggaatcaagccattgagaacattcaacaaggttgacttaccgctaccgctttggccgcataacacgacgacttcaccagcaaaaatctgacaagagacatctttcaatacctgctgggtgccccgtttaagagatagtttttcgatggtgatcattccttcacatccttacaaacaaaaaaataagtagtaacacagtaccaaacactacataatcagcaagtttcaaccgcagtgtataaaccgatgtatgaggatttttagccgacaggcctcttactaacgcggtcgctgacaattctgtggcagtattttctgcagacatcaataaaggaatcaaaaaatactccaccgtctgtagaggatgtcttacataggaccagccgttcaaagcaattccgcgaaagcgcatcgcttggcgaatacttttgacatcttgcaacaatgttggaaaaaatcgaaacagtacggccagcggtaccagcaaaaacgagggaatgcggattttttgcaaagcagctaaccattcactgattttcgtcccactcatcgcaaatacggctgccatgatcgtcggtaacaatcggcgataccctacggaaaagaaatccagcagggtggttactattgaattgttttgccctgcaaaaaaaccttctaccaaagacaataatagaaacagcccgaaaaacaacaatccctttcgccagaaaccgctaagtagaaacaagataaacaaaaagctgatcacaatcaactcttttgtccacgtcaatgaaatcatcaatgtgacacttgcaaagaatgtcacaaataatttgcatctggggtcaagtgagagcctagtcacatcgatctcccgtttgtttgatgcaacgttggttggaaatgtttttgatatagacgagcaccgaggcctatcccgacaatcgaagcaaccagtacagcgagcccgcaaatcaccagcatcgctgtggaagtatgagcaaagacccctgcaatatagctttggtcttttccacgagcaactagcgaatcaatatacgcatttttcatgaaccacaatggcaagatgggacccattaaaccaaagctgaatacggtataactaatagttgtcttgagacttcctttccacttgcttttatactgaatcgtatctgccagtactgcacataaaatattcggcataaaggctagcggaaagtgacctgaaatcaaaaaaaagagacctaccacactgcccatgatggtgatcgcgccaaactttggtactttattcaacatcaatagataaatgaccccagaaaaaagtgctgtaacggctggaatgaataaattatgaaatcctggaataacaaaccgtaaaatcagcagacaaaaactcatcaataaaaaataaatagctgtatatatcccgacagcaatcaggtcttgaacttttaaatttttcatttcttatgctccttctttcaagcaccggttcttggtgcgattacaagcatctagtatagcacattcccgcgcgaaacaatggaaatgatgcttatctagtctaagacggtataatctgtgccaaattcaagtgctacccagtcactggaatctgtcttcgtattaacagttaacccatccaacaaaatcttttcgttcaatgtatcgcgaatcgtatagtagtcagcgtaaatttcgtcgcctgcagagactggaatatccgcaacttgattgccatctttgtcataaactggtgtaataaccatgtctttcgctgcaatttgatagagtccgcttggaagagtggcattggcttcccaagtgaaatgatttcctgctttattggagaaaccttttccttcttcaacggtcttatctggttcaagcaaagattccataatgttcttcggttgaacgactacatcatagattaatgagcctagatcatcacggtccgtttgaggtacttgcacaaagaatggatctgctggttttgcaacggcaggagagacaccacggtcatcttctaattcggtaactaaataaatgccatctgccgcattgccgctacccaaattcgctttgacagacccatctgctcctgtcgttactgtttgagcagtaaatgtgttgtcaatcgtataatcggttccttctttttgatctaatggattcgttaaagcagcatcaccgattgccgttacccgttgtatgcggaatttgatccctgctaacggctactttgtaactgtatcatccttttctccatcgccacgatcacccagttcagatagatctttcacttcatatttccaaagtgtaatggaacgagggctagtattatctgcaacaggacctgtagtcgctgcataggcagataaagtgccaacagctggaaccaccaaactacctgctgtgaaaagagttgttgcaacaacgaactttgtaactaattttttctttcgtttcatttctgtaccttctttcatatttttttaaatctttcctaacctacacatgcctaaacaaccaatccaacattttcgttttacataaagatcactcctaaaaaagtgcaaagattatctaaacagattatcggatatttttgctattaggaactgacaaaatcctttcaaaaaataagtatttgagtctcattcttacttagtaatctttttaaaaaaggagtaattcttatcattttgcgcctggaaatgaatggataaaagcgatttttatctcagacttgagcatttttttaataaataaggacattttacttcgtttttttctgaaatatgtgttaaaaatcacatgatttgggattgagaaatctctttcacttattgacctgtttatgaaaaagacaaaattcaaaataaatcaacttattttgtcatattgcgcatttttaacggtttctctctattcgttgatagacaaaaaacaaaaaacacctcataaatctccgtataaacaagagatttatgaggcgagtcaattaatgaaataaccccaatttgaattggatcaatactgttagtttgtcgtttttgttgcggatgaaaggaagcaagaatcaccaaatagatcaccgactgcttcttttcaacaaaaaatctaatagataagaattgacaaaactaaatagtaatccaattactactgatttgaagccataagtcaaaaatcctaatattaataccataaagttgatatagcggataccccgagcaatactaaaatcaggccgctttttgttgatagccatggcaatcacatccatcccaacagttgaagcgttagccgtgatgcagcaatagtaccctaccgctatgaacaagctcgcaaataagaaatcaagcattaggtttacttgaaaatcaatcttcatataataaaaaagagcaaaaaataaattataaaaacactgctgataatggacttgaaaaaattggcttttcctaaaaatagccaacaaaaaaccagcagaagggtcgtaataccagatgtcaaataaacgatcggtacattggtcaccttttctaaaatcatcgccatactagtgacaccaccattgatgatcccattaggtttcatccatttcgcataagcaaatcccaacaaactattacccgcgatgatttttaggactgcctttgattcttccaatacttcattcctcgttactagtttcatttgatatcctcccagccttaacaggaatccgattttattgtagactactataccattagtcaagcgaatttggtattttgcttagcggaagaaacaaaaaacccgctcattgagcgggttcaatcgttgtagaacaacgtgagtttatttgtttaaagcgtcttttgcttggtcagccaatgcagtaaatgctgttgcatcgtttacagccaagtcagctaacattttgcggttgatgtcgatttcagctaatttcaaaccgtgcatcaattttgagtagcttaagccattcatacgagccgctgcgttgatacgagcaatccacaatttgcggaagtcgcgtttcttttgacgacgatcgcggtatgcgtagttgtatgaattcattacttgttcttttgctgttttaaataaagtgtgtttagaaccgtagtaaccttttgctaattttagcacttttttacgacgtttacgagttactgttccacctttaacacgtgccatgtataattcctcctaatatgaaaatcgatagttgtttgaatttgtaaagcctgggacgcaattatttcatgcgtgctaattgttgacggatacgtttgtaatcgccagctgaaaccatagaagctttacgcaattgacgacgttgtttttttgttttaccgtggaaacggtggctagtaaatgcacggaagcgtttcaatccgccgccgccagtacgttttacgcgttttgctaatccgcggtgtgttttttgttttggcataactaatttcctcctcaaaatctttcgttatctgactttaaactgaaactcagtgagtcattatttatcattttttggcgataatactaagaacatgctgcgtccatccatttttggtttttgttcaacggatgctaaatcagctgtttcttcagccaaacgatccaacactttctgaccaatctctttatgggtaatggcacggcctttgaaacggatcgaagcttttactttgtcccctttttcaaggaatttacgtgcattacgcaactttgtgttgaaatcattgacgtcgatcgttggacttaaacgaacctctttaatgttgattactttttgttttttacgagcttcacggtctttcttctgttgctcaaaacgatattttccgtaatccataattcttgctaccggtggtttcgcatttggtgccaccaataccacatcaaggtttgctcgttctgcaatttgcaatgcttcagctttactctttacaccaagttgttcgccgttttgatcaatcaaacgcaattcacgtgcacgaatgccgtcgtttaccatcatatcctttgctatggtcattcacctccgagttttttgagagaaagaaaagcttgtcgattcgaaatcagacaataaaaaaaacgagttcttcacgaacccgcacgtactccatacacaaaatgtaggaatcctattctgcccagcgatacagtcactcaggcgagaagcgggtgcttctgctttaatttctcaacttttatagtatactgctttttttagttcttgtcaatgattttcatgattatttcaaaaaagagcgcttaacaaaagtgaccagccacctgaagtttcggcttggttccaaagaagctacttctaatcgtttatttgaaaaaagaagctgcgacaagatttttgtcacagctccctcagctatttattattcagctttcaatgcagccattgtgatgtagttgtatggttgattgaagtgtggtaagaagaagatatcaagtaatttcatcttgtcgatggttacaccttcttcaattgctaatgagaacatgtgaattcccatagcgatttctgaagtacgtgatgccatttgggcaccaatcacccgacgtgattcttcttcgtaaacaatccggattttcacggtatcgttttctttcatgaatccaggtttttgcgtatcttcataatctgaatacttcactttcacaccgttacgttctgctgcttctacggaaagaccggtagaaaccatgttgtaaccaaagattgagattccgtttgatccttggaccccagttgattccaatgatgtaccgccaatgttatggccagctacgatccctgagcgaacggcatttgttgctaaagcgatgtaggtcgtttgttgcaatgcatttgaataaaccgttgcacagtctccaaccgcaaaaacatctgggtcacttgtttgttggtgacggtctaccaagtaggcaccattcgtaaatagttccaagtgctctttgcctaatgtattgtttggcaagaagccgatcgcattgatcacaagatccactggatattctccattatccgttaccactgcttctactttgtcggttcctttgtattctcgagctaattcaccaaagtgcaattcgatcccatgctctgctaagttttgatccatgtcatccgtgaaccatttgtcatagtagtttggtaatgcacggttagcggcatcaaataaaagaacgtttttaccacgacgttttgcagcttctgcaatttccactccaatatagccggccccgatgacagcaacattttttacttcttcagctgctagttctttatccacagattggccatcttggaatctcttcaagaaatgaatattggctaaatcacgaccaggtacttttggcgaaattggtactgaacctgttgctaaaacaagtttgtcatatgtttctaccacttcttcaccatcttttgttactgcatgaaccgtttttttctcaaaatcaatatggtcaacagttgtttccatatagatttttgctccctttgcctcaaaatcttcccgttttgtatagaataagccttcatacgaatcgatttgacgtccaacccataatgcagtcccacaaccaaggtaactgaggtttgtattccgatcgatcattacaacttcttgatcttggtaattgtctaataaggtatttgctgcggcaatccctgcgtggttcgcaccaataatcactgtttttgtcatggaaaaatttcccccttttgtttatggtttcattatagctacattgtgaatttaaaaactatcaagattttcgcaaaccgttaaaaaaatgacagtttttactggttattgccgaattatccttgaattatgcttctgaaatgaagatttttcttaaaacaattcataaccttgtgaatataagcgtatttatttttcataaaaccttgctatttcagcagctaaagttagcctattgaattaaattcacaatctatccatcaaacatctttgcactgcaaaaggcatcgctcaaaacatggtatactattaaaaaaacaaaattttgaggtgcaaaatgaaaaaaaagcagccggatcctcttttaccgattattgaatactcagaaacaaaagatttttatcttgaagatgaagaaatttttgaacaagctttttttacagaaactgatgccagttatgacgcttgtacgggtctcattttaaaacagtgccacttgaaaaaggtcaccatgcaaaagacaagactagagcattgggaatgccaaaatgttttctttgaaaactgcgacttttccaacatggaatgtttgggcgctagctttcatcaagtacacttcaaaaactgcaagctgaccggtacaaattttgcagaaagttattttcgtgactgtacatttgaatcttgcgtcggcaattttgcttccttcagcaacaccaatctcaaaacgatccgctttgcagagtgccagctgaatgacacagaattttacgaagtccaatggaaaaatctccagttgcagcacaatcagctgacaaacagtaattggttccgaaccaaactctatcagctggatctgcggaccaatcctttccagaaaatcgctctttcgcaagaattgttgcggggattgatcgttgaccaagaacaagcattagtgattgcagcggggttaggtctagtgattgactgaagcatcacttgattctgcgccagagtgcaatcaacatccatcctgacaagactaaactgatcagcagagcgattccccagccaaacacggtattcgtgaagggcaatggaacgttcatgccaaagaagctggtaacgatcgatggtaccgtcagcaacaacgaccaaacagtcaggaatttcatcgtgtcgttcaagttgttgttcaacaaattattgtacgtacctgacaattgttccagaatttgaaacgctaactgagtcatttcaacggcttgtttcgcttcgatcagtgcatcatccaactgctctttttcattgtcgtccattaaacgaaagaacgacaaagctttgatctgttctaataaaacggcattttgtttcgttgccgaaaccagataaacgagtccgatctccaagtcagacatctccaacaaatttttattggtggtcttttcccgcagccgttgattgagatgcacgcgatcgctattgacttcttcgactaaaggaaaaaaagttcctgagatcaaaaaaagactattaaaaagaaaatgaatcggtgtttgcaaaggattttgcacgagtatccgttccatcatcggaatcacatattgtgtatttctcgaagaaaaagtaaacagccgatctttttttaagataaacgtcatcggacttgtttcaaaatgattgtctttcttttcttgttgaggtacgttgaacaccaacaacaatgcttgatcatcagtatcgaactccacacgggcacgttcattcttgtctaatgagtaagttaacatctcatcagtcaactggtgctgtctttgtaaacgcgcaatactgctactgtcttgttgatccacttgaatccattcataacggccattgtaaaatcgttttttttccactggtttccctccacacgttacatgttcgctttcttctattataaaagaaaacagctggaatccccacttttatgggctggactccagctgttgctttatttgcgcacttttgccagtgcttcgtcgaccatcgctaataccttttgggctgcttctggatcttcaacaaagttgaattgatcgccgtcgatttggatttttggactttcttggtattcttcataccattgatcataccgtagattcaattcttgataatagtcatacaaggtaggatcaaaggataactgttcatattcccgtccccgtttattgatccgttctaacatagtttcaaaagaaacccgaatatggaccaataaatctggatgttttttatgagctgcataaggcaattcttccaacatgttggccaataaatcatcataaacccgaacttctgtatccgttgctcgccctaaatcagcattcaaatggaaaagcagtgaatcttcataaatggatcgatccaatacattattatcatcattcaatgcttttttgatactatcaaaacgtttattcaaaaaataaatctgcaataaaaaagcatatttatttggatcggcataaaacaacggcagcacttcattatcatcgattgactcataaaatgcttgactgcctaaatgatcagctaacaatgcagttaaacttgattttcctgcgccgatagttcctgctaatacgatcacgctcatatcccccaactcactcatcactaaatattgtatgtttcatttgcgtaatcaactatacactactagatattgtatcgtcaacccagcgcttttgaagcataaaaacaaaaaattttcaataaaagtttaaatattttcagttttttacgatttctttttcggaatgcttaacgaaacagccttcttctagtaaaataagaaagaatcttttattcgtttttctgcgaacttttctgttctaacggaaaaacaaggatctatgatgaaatcactagtaattattaagtagattgcagcttagtttaaaagaatgactcacaggatcaaaggggaacctttatttttttgcctgctgcttcctctgagacattcttttgacttctgctgcagttctaagagaaatgaggataatgaatgtcactcggtactggcatagctacagggaaaatcatattaatgggtgaacattcggtcgtctatggtgaacccgccatcgcttttccatttgctggcgcaaaggtccacgtgacgatcactgccagcctaacgaatgatttaacctccaattattaccacggcccactagaagaagctccttcgcatttaaaaaatgtgaaagaacttcttcatcgcttgcagcaagaccatcaaaccggtcccttttctgtttcgatcgttagtacaatcccttcagaacgaggaatgggttcaagtgcggcagttgcagttgcgttgactcgggccttttttgattggcagcacaaagagttaaaaaaagaacggctattggattatgtcgatttttctgagaaaatcgcgcatggaaatcctagcggtattgatgctgcagcaacaagcggcaacgaggcgatctactttaccaaagggcagccgattacttcttttccattgacgatcgatggctttttgttagtcgccgatacagggatcaaaggtcagacccgcacagctgtcaaaagcgtcgcgcatctgtttgaaacgcaaaaacaccaaacgagtcaggctatcagccgcttaggttctttagcaaagaccgctaaagaagctatcttacataatcagctgacgcagctaggtcaggcaatgacccacgcacatgagaccctccggcaactaggtgtcagcaatcaaaacctggacgatctcgtgtcactggcattagccaacggcgcttttggcgcaaagctgacgggcggtggccgcggtggctgtatgatcgctttgactcaaacaaaaacacaggctgaagtgatcagccgtattttattgtccaatggcgcccatgccacttggattcaaggattaggagcttacgaacatgtataaaggaaaggcgcgagcctacacgaatattgctttgatcaaatattggggcaaggagaacgaaacactgatcttgccaatgaataacagcttatctttgacgttagatgctttctatacagaaacctctgttaccttttcagaggaatatactcaagaccgttttttcctggatgacaaacagcagagtgaggctgcaacgaagaaaatctccgcttttttggatcttgtacgcgcaaaagccaattgtccttttttcgcgcaagtcaacagccgcaatttcgttccaacagctgctggtcttgcttcatctgctagtggactagctgctttagccggagcctgtaacgcagcacttgacttacaattatcacaaacagaactatcccgtctcgctcggcggggatctggctctgcttgtcgcagtatttttggcggctttgtcgaatggcatactggtgatgatgacacgtcttacgcaacaccgattgcttcggaaggctgggaaaaagagctaagtatgcttttcattttgatcaacgacaaagcaaaagatgtttccagtcgtgacgggatgcgtcggactgtagagacttccagctattattctggttggctagaaagcacaccacacgatttgaaaaagttaaagcaagccatccgcgaaaaagactttcagttattaggtgaaacgacagaagccaatgccctaaaaatgcatgccactactatggcggcgactccaccgttcacctactggtctcctgaatccttgcgagcaatggattgcgtccgttccttgcgtcaaaaagggctggcctgctactttacgatggatgccggaccaaatgtcaaagtgctttgtcaaagaaaagacgaagaagctatattaacccagctgaaaaaagattttcatcctgaacaattaatcgttgctcacgcaggacaagggttggttgatttaccaatgacagtgaccgatccgtctatgacaaatgaaggagtgtcgaaatgatagaaatctcagtccccggcaaattatttattgcaggtgagtatgcggtcgttgaacctggacatccagcgatcatcgttgcggtggatcaattcatcaatgtgacgatcgaaggcgcccgcaaaaacggcagtatccaatctgcccagtacagtgacttgccgatccgctggacccgccgcaatggcgaactagtactggaccaccgagaaaatccttttcattacattctagctgctattcgtctaacagaaaaatacgctcaagaaaaaggaaccctgctctctttttatgacttaaaagtaacgagtgagttagataattccaacggtcgaaaatatggacttggttctagcggtgcagtgaccgttgctaccgtcaaagcactcaacctctactatgatctaaaaatggatcgcttgacgcaattcaagatcgccgcattggcccatttggccgtgcaagggaatggctcgtgtggtgacattgctgcttcttgctatggcggctggctggctttttccacatttgatcatgagtgggtcttacgaaaacagcaggaatggacattgactcagctattgaccagtgattggccagagctttcgatccgtccattgattgtcccaaaatcattgcgcctgttgattgggtggacaggtagtcctgcttccacttctgatttagttgaccaagtctaccaatcaaaagaagccaaagaaaagggctatgccaaatttttggcagacagcaaagactgtgtcaatcgtttgattgatggctttttaaatgaagacagccgaacaatcaaaaaaatgattaccgaaaatcgaaaattacttgtaggattatctagtctgactggtgtaaccattgaaacacccgctttaaagaaactatgtgacttagcagaaacctatcgcggggccgccaagtcttcaggcgctggcggcggggattgcggcattgtgatcgtcgatcaaaaaaccgggatcttaccattgatgagcgcttgggaaaaagccgacattattccattgccgctgcatgtctatcattatcgggaggagatttaatgaatcgaaaagatgaacacgtctcattggcaaaagcctttcacaagccacggttgaatgattttgatgcggttcaaattattcaccagtcctttcccgagatcgatagcgcacaagtcactttggaaacggaactctttggccgctctttcgctaccccttttttcatcaacgccatgacaggcggaagtgagaaaagcaaaaaaatcaaccaagacttggctgaagttgcgaaagcttgtgacctgatgatggcgactggttctgtctcagctgcattaaaagacccagcgctgtccgacacgttccaagtcgttcgccaagtcaatccagagggctttcttttagcaaatgtcggtgctggtagttccgttgaaaatgccttgcgtgcgatcgacttatttgaagccgatgccttacagatccatctgaatgcccctcaagaattggtgatgccagaaggggaccgtgaattcagcaattggctaagtctgctggaacaaatcgtaaaggcggctccagtaccagttgtcgtaaaagaagtcggttttggtatgacccgagagactattcagcaattgatttcggtaggcgtacaaacgatcgatgttgctggtagcggcggaacgagttttacccaaattgaaaatgcccgcagaaaaaaacgagaaatggcttacttgaatcacttcggccaatcgacggttatttctttactagaagccaacgaagtgcaacactccttcacgacaatcgcttcaggagggattcgagatgcctttgatattttcaaagctttatgtcttggtgccaaaagtgtcggaatctctgctacgattttgaccatgctcttagataaaggacctgaagaaacgattgccaccatccagtcttggaaagaacagcttcagctgctctacaccatggtcggacaaaccctgacacaggatttgaccaatgtaccgctaattttctccggtcctgtcaaagactggtgtcatgcccggcatatttcgttgtcggattatagttttcgctaaaaaagaggctgggacagaaatgttaaactccgcaaaataaggaggaatacacggaaattgcttttcaaattttggggtagttcgattaatttctcggagttgcttctgcttccgccatttagacgtgtttagagcgtgggacaaaagtgttttttacttttgtcccacgctctttttgtctactgatcatggagagtcgcttctgcttcgtttgcttgctgctccgcaaaaagtttactatcgtacattcggaaaaatggataatagcagacaaccgaaatcaataaattaaggatagcgatcaagattccgcgaaaatcaccgccagttccaagaaatgctccaatcccaacaggtgagatccaaggaatcccggtgatcactttagctacaaagccaaaggatgtagcaaaataagcaatcgtcacattgatcagcggtgtcacaataaaaggaataatcaaataaggattatagacgattggcgcaccaaagatcactggttcattgatattgaacaatcctggaaggatcgccgctttgcccaatactttcaactgttgggatttagctcgaaacagcatcaacaagaccaaccctaacgtactgccagcaccgccaataaaaatgtacatattgacaaaatcaccggcaaaaatgttggttgctccatcgatgttttcggttaaagcaactaataaaataggattgataaaactgtttttgatgacggctgttccgtgaacaccaacggcccacaacaaatgaatcaacaacatgattacaatgatccctagccaagaacctgtcaaatcttttacaaattcaaatggttttgacaacaaaccatgcaagtcggtatgaaaaacggctaaacagccattgatcagaatcatcaaaaaagcaataataatcgctggaatcagggaagcaaatgctttactgaccccatctggtactcccgctggcatttggatcgtgattttctttttaacacaaaaacgatagacttgggttgccagcaccgccgtaaggataccgataaaaataccgaccccactaaaccgtgtcacccaagaaccaagtgctacaccattatagatgatagctgtctctccagttgtttgaagcaattgtgccccactatctgaaatatcgacttgaatgatcgtcatcaaaaatgcaaacaacccaagaattgcgccaacaaagctgctcaattggagtttttcttctttgcgatagatgtccgttaaataatacgcagtggctaaacaataaaagagtgcgatcgagccgatagacatagttgtcgcgacactataaagcggggaaaatttcaaaatcgtctgttcaaaaaagctggccagcggcggaataatttgaggcaggttattgatgatcaaaaaaatcgagccaacgatcgtgaaaggaaccgtgatgactcccgcttgcataattgcccggataaaacgcaagttagcgactttatttaatggcggcatcaatcgctgctctaaaaaagtaaagacatgattcattgcttatccctcccaatgtccgttttcgatcaacttttgataccagtaaaaactatcttttttcacacgcttttgctctttttcatcggcatcattccgatccacataaataaaaccatagcgctttttgatgccttcatggacactgatcaaatcgatcgcagaccaaggactatagccaatcaattccactcctgactcgatagctgctagacattgctggatgtgctgctgcaaatagtcgatacggtaagaatcatggactgcgccgttttcttccagatgatcttctgctcccaaaccgttttctgtgatgaggattggtagatggtagcgatcatagagtgtttgcaaagtcgtttttaagcccagaggatcaatggtccagttaaacgcatttttcttcaaatagggattcgtaaatcctttataaaaccctcgttccatgatgtcttcactttgttgatcactgatcccattcgtcatgtctccttccatcgttggctgttcaactgtgaccgttgtatagaaattcatagctacaaagtctgggaaggcactggtcatcaaagcctgatcctctgggtggatagtgatcttcaccccattttgattcaagtaatcttgaaagactgtattgtagcgtcctaagcaggcaaaatctaaatacgcccaattccgaacgctattgaaataaagggccgcctgattgtcttccggcttgctggttgctgcataaacaagcgagatattagggactggtccaatttttccatttggaacgagttcatggcaatgtttgaaggcaagcttttcagcaatcatcagatgatggaattgctggtacttctcaggtagagcaatcgttttgcctagtatcttgcgatcgactaagagcatgatattcggttcattgatcgtcaaccaatgggtcacccgatcaccataagcgttgaacaatgtcttagcataggtttcaaaagcttcaactgtactgcgatttgtccagccgccttgatcttccaatgcttgtggtaaatcaaaatgatttaacgtaataaatggttggattccctgcttcaacagttcgtcgatgacagcactataatggtccaatcctttctggttaacacttccccgcccctcagggtagatccgtgaccatgcaattgaaaagcgaaaaactttgattcctagttctgctaacaaggcgatatcttccttgtaccgatggtaatgatccaccgctactgtaaaatcggcgatctcgttattgtctcggggacgagtatcttgaacacttagtcctttaccatccgctaaataagctccttctgtttgatgtgcggaaatggatgctccccataaaaaatctgttggaaattttgatgtcatgatgttctcctgtcttttttagtaaatcgctttctggtatttaggataatcgtctccttgatcaaaagcaatagccggacaagaactgttcatgaaagaatatttatgaacgattctccttaattgattgtctgagaaaagcttcaatgccaaattaaaatcatagcagcgaaaactgcagaccttgagaagaaaattgcgccgtctcgatctctgtaagttgcctattgctaaacaagcgattcgccataaacgtacgatcaatcataaatcctcggacatggccgatattttctccttccgtatagatgattttctctccttgagtatgctgaagcatcgtccgatacacaaaggattcacttagtgtcgttgttgtgatttcatgggagtcgattcctgaggcttcaatcaaacacaaatcagccgtatatttgctgaaagccagtgtcgctatatctccgactaacgcagtggagttgctttccacttctcctccacacagacaaacaatcgcccgtcctggttttagatcaatcaatgcggaatggtcattggtcacaatcgttaaatcaaaatcagcaactgcgtggatcaattctttcgaccagcgtccagcccccacaaaaatcaatttcttttcttgcagcaaaaggtgtaacggtggaagcagtcgctgccaaggaaattcttctaccgatccaagttgctgggattctcttttttctgatttcttgatccgtttcacgccgccataataacgttcaatcaactgctttttttccagaaacaacaaatccctgcgaatcgtcacttctgatacttgaaatcgatccgctaattctgaaacagtcccataatcatacttatctaagtaggtgatcaaggcctctcgtcgtcgaaaaacacttccctgtgtggctttcattttttcaccttctatacgttttttgaatttttgattgcccgacctctttgagtcagtttaccttattatcagcgaaatgtctgtgccttatgtcgtaaaaaccccccagtaatcgaatcgattactggggggttggacgttgatttacgtttgcaaaatcttctcttgcggataactagttaagaaaattatttcttctctgctttatcgtcagtcaataatgctttgcgagacaaattaattcgaccttgtttgtcgatctctgtgactttcacaagaacttcatcgccttctttgacaacatcttctactttgttgacccgttcatttgcaagttgagaaatgtgaactaacccatctttgcctttgatcaagttgacaaaagcgccgaatttttcaacacgaacaacttttcctaaataaacttcgccaactttgacttcttttgttagatcttcaatgatcttaatagctttcttgatcatttccgcatcagaagaagcaattgatacttttccgtcttgatcgatgtcgatcttcacgcctgtttcatcaatgatgccattgatcgtgtcgccacctttaccaatcacatctttgattttggctgggtcgatttggatcatctcgatcttcggtgcgtatggactcaattcttcccgtggcgcagcaatagttgaagtcaattcatttaagatttccatccgtgcttttttcgcttgcgatagagcttcagttaagatttgctcggtgattccttggatcttgatatccatttgtaaggctgtgattccatcttttgttccggcaactttaaagtccatatcgcctaaatgatcttccaatccttggatgtcggtcaagatcgtatagttttcgccatcagagacaagtcccatcgcgataccagcaacaggggctttgattggaacaccagcatccatcaatgccaatgtacccgcacaaatacttgcttgtgaggatgaaccattggattctaatacttctgccactaaacggattgtgtaagggaaatcctcttcacttgggattacttgcgccaaggcacgttcacctaaagcgccatgtccgatctcacgacggcctggagaaccggcacgtcctgttgaaccaactgaaaactgcgggaaattatagtggtggatgaaccgttttgattcttctacccctaaaccatcaatgatttgatgttcacccaatggtgccaatgtacaagcagataatgcttgcgtttgcccacgagtgaatagtcctgaaccatgaacacgaggcaacagaccgacttctgaggctaatggacgaatttcatccaatttccggccatcgggacgaattttgtcgatcgtgatcaattcacggacaacatctttttcaaggtcttctgcgatttgtttcacttcttttagaagctgcgcttcatcctcatgacccgcaaatttttctgcataaacttctttaactgtttctttgacgttgtcgatctcgtcttcacgagccaatttttcttcggtcataacagccgttttcattgtttgatagtagccatcgaaaatttcttttttcaagtcagcatctacttgaagcaaagtcacttccatttttggtttaccgactgctgcaacgatttcttcttggaaaacaactaattctttgattgcttcaaaaccgaacagcaaagcgcctaacatatcatcttcagaaacttctttcgctcctgattctaccatgttgatggcttttttcgtaccagcaaccgtcaattcgatatctgtttgctctgcttgttcaacggttggattcaacacatattccccattgacacggccaacttcaacaccagcgattggtccgtcaaaaggcacatcggaaatagacaacgctaaagaagagcctagcattgcagccattgctggtgagcaatcttgttccacactcatgacaatgtttgtcacttggacttcatttcggaaaccatccgcaaacattggacggattggacggtcgatcaaacgagcagtcaatgttgcttcggtacttggacgaccttcacgtttgatgaaaccaccaggaactttcccgactgcgtacattttttcttcataattgatcgttaaagggaagaagtctgtatcttttgcttcttttgaagcaacggctgcactaagaactactgtatcgccatagcggacgagtactgcgccatttgcttgtttggctaattggccaacttcaacttgtagcggacgcccgccccaaatcgttttgaatacttgtttttctgtcatgatctgctcctttttttctgagccaagcaagtcactactaaacaaatgaaaaaagtggatcggtgcttccgctgctttcatttggttagtaggaagctgctcgccgtgtctcagagattcttttttagttgcgggtttgattcaccagtcaagtcccgctaattgagtttgttaaaaagatggggccactattattagtcgcctagtactattcatcatctgctctgtacggcttgtgccgcccagtcgcagtgattccgctcgggtgactacgctcctggttagtcgcctagtactattcatcatctgctctgtacggcttgtgccgcccagtcgcagtgattccgctcgggtgactacgctcctggttagtcgcctagtactattctccacttcnnnnnnnnnnnnnnnnnnnnnnnnnnnnnagagtccacgggtatttatcttggagagtaaacctctcaaaactgaacaaaggcaaacgatgtgtagtcttccgtactattccttagaaaggaggtgatccagccgcaccttccgatacggctaccttgttacgacttcaccccaatcatctatcccaccttaggcggctggctccaaaaaggttacctcaccgacttcgggtgttacaaactctcgtggtgtgacgggcggtgtgtacaaggcccgggaacgtattcaccgcggcgtgctgatccgcgattactagcgattccggcttcatgtaggcgagttgcagcctacaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtctcgctagagtgcccaactaaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgtttgctgcagcactgaagggcggaaaccctccaacacttagcactcatcgtttacggcgtggactaccagggtatctaatcctgttcgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacgttctactctcatccttgttcttctctaacaacagagttttacgatccgaaaaccttcttcactcacgcggcgttgctcggtcagactttcgtccattgccgaagattccctactgctgcctcccgtaggagtctgggccgtgtctcagtcccagtgtggccgatcaccctctcaggtcggctatgcatcgtggccttggtgagccgttacctcaccaactagctaatgcaccgcgggtccatccatcagtgacgcaaaagcgcctttcaactttcttccatgcggaaaatagtgttatacggtattagcacctgtttccaagtgttatccccttctgatgggcaggttacccacgtgttactcacccgttcgccactctttttctttcggtggagcaagctccggtgaaagaaaaagcgttcgacttgcatgtattaggcacgccgccagcgttcgtcctgagccaggatcaaactctcataaaattccagaagcattatctggtatctctactacataccagcctgggatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcactgaaaattccataggcattatctggcgtctctactacataccaaccaggaatctctttggcttcactggcatatggtaacccgacttttccacttaagatagttggctctgctaattgatttccttcactatcttggtatttcacagtcactggtgccgcatcactgcgttcgtatacatacaccacttcctgcgcttcttcactgaaaattccagaggcattggctggcgtctctactacataccaaccaggaatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcactgaaaattccatatgcattatctggcgtctctactacataccaaccaggaatctctttggcttcactggcatatggtaacccgacttttccacttaagacagttggctctgctaattgatttccttcactatcttggtatctcacagtcactggagcagcttcactgcgttcgtatacatacaccacttcctgcgcttcttcactgaaaattccagaggcattggctggcgtctctactacataccaaccaggaatctctttggcttcactggcatatggtaacccgactttgccattcaaaatcgttgggtcgcttaattcgttgccgtctgtatcttcatatcggaccgtaactggtgccgcatctgagcgatcatacacgtagaccacttcttgcgctgcctcaccgaaaattccataggcattatctggcgtctccactacataccaacctgggatttctttggcttcactgatataaggtagtccgacttttccgcttagaatcgttggctctgttaattgattcccttcactatcttggtatttcacagtcactggtgccgcatcactgcgttcgtatacatacaccacttcctgcgcttcctcattgaaaattccagaagcattatctggcgtctctactacataccaacctgggatttctttggcttcactggcatatggtagtccgactttgccattcaaaatcgttgggtcgcttaattcgttgccgtctgtatcttcatatcggaccgtaactggtgccgcatctgagcgatcatacacgtagaccacttcctgcgcttcttcaccaaagagtccggaagcattatctggtgtctctactacataccaaccagggatttctttggcttcactggcatatggtagtccgactttcccacttagaatcgttgggtcgcttaattcgttaccgtctgtatctttatatctgactgtgactggtgccgcatcgctgcgatcgtatatatacaccacttcttgcgcttcctcgctgaaaattccagaggcattatctggcgtctctactacataccaacctgggatttctttggcttcactggcatatggtagtccgactttgccattcaaaatcgttgggtcgcttaattcgttgccgtctgtatcttcatatcggaccgtaactggtgccgcatctgagcgatcatacacgtagaccacttcctgcgcttcttcaccaaagagtccggaagcattatctggcgtctctactacataccaacctgagatttctttggcttcactggtatatggcaatccgactttgccattcaaaatcgttgggtcgcttaactcattgccgtctgtatctttatatctgactgtgactggtgccgcatctgaacgctcataaacatagaccacttcttgtgcttcttcagtaaatacaccgactgcattatctggtattttgaccacgttccagcccgcgatctctttcggattgctttcataaaccataccgacttttccacttaaaaccgttggttcactcagctgttcgccttcagaattctgatacttgactgttacaggagctgcatctattaaattgggctgccaaacatacgtatcggagtcagtttctccattgtagtttgccattaactcggaagccgaccaaatatttagcccattcgggaaatctattgatcctgttccaacattgacccattttcctgtataaatttctgatgaaattggactaggcaacattgcatttgtataaaatgaaaatgactgtcctaatctgatgatcttcaacgattgcataccgctaaacatagaagacatattcgttaccttactggtatcgaaacttgatatatccagactagagactctatttaagccctgaaacattcgatccatattcgttacttggctagtatcaaaattgcttagatccatactgaatgtatcgagatcacttcttcttaggtttgcgaacatcaaagacatgtccgtaacatttctcgtatcaaaattgcttaaatcaaatttatcgatattaatcacattcgcgaacatcaaagacatattcgttacatttcttgtatcaaaattggagacgtccaaactagtcaaatcgaacagtccattgaacatcgcatacatattagtaacgttacttgtatcaaagttggatacatcgagctttgttaaccctcgagtattattaaacatgccagacatattcgttactcggctagtatccagcttgtccaagccttctatttcagtaaggtcagcccacgtaccgccggagttaccaaataaataagaagaatcctcaccagcaataacattcccctcgaacacaatttttttaaccctataccgggaccaagggttaatctcagaagtagatcggaatgttccagatccgatatggagaactccgtcataagtgatataccaatctgaagtaccataagttcccgaggccatattttcagtaggatcttcagtagtttgattctctattacatctgtttcattttgacttctaacttcattctcacttgaagaagaagtcgattcgttcagttcgacaggttctgaactatctgattgactaagttcactgggctctgtattccttccatcattatctttcgttgaatgaatgtgttcatccttactatcacgagacattaaagtttcttcttgttccacagcgatcgtgctctctactgtatcctgtatagaaacagtatcttcagtcactgaatcagcgctaacaaccattgtccatggcgcttgatttaacaacaagcctcccaacaatagtatcctgctacactttcccataccaagtcatcctttctcttttagtctttctctttagtatccatattccgattatcatcaatggatgttattacctacatgttttgtattgtctctgtgctaaaggtgttttgttaatcaaaccatgcgctttacctgctgattcgctttcaagctttcaataaggttcgatctaaagaattttctttaaaaagttgttcccaaccctcaacttcgacaaatggattttctgaggctttctgtatgcatgtaccttcttctagtgccaaaaatcttcgttttttagataatagtttctcatttagacattttttcgacaaaaatctataattcaagttttgtaagacattcgaagttttcggatgtctattttcgtattgtcccaaaaacgaaggtttttgagacagatagattattttacattctctgaatatattactattcatcgcagctttctcttaatcaactatttctccagacagtgaaatagttgatttgctttttactccaaccttatctacagttccaaatcaaatcgcttcgcctatccttgctttttttgttaagataaagaaataatgagtaagaatttaggtgatgatttatgcgactgttgtttttctttttccttttcacatttttgattggatttctcttctatttattgacccgtcgcacgatcgccgaagtctatcatgaattgaccgataagaaccgcttctttcgaggcatcaaagctttcttcattggaatttatcgcattttgacttctgtttaaaaaaaactgtccaacaacagatctcttgatcgttgctggacagttttttgtttgattcgtcttctatttcaatggtttccattgccaatcttggacttcagcaatgtcatagccattctcacggataaagtcatggtgataggcaaccgtctctgtcattcgttgcgcaaagtcggcagcttgttcgccatagacccactcagcgccgtctttcgctaaatggaagcgatcaagttcagataagatccgcatgtcaaatggtgtggtgatatcgccattttcacgatagccatgaatatgcagacgctgattcttgcggccgaagaaaatgtcccgaatcagtccttcatagccatggaaagcaaaaatgattggcttgtccttagtaaagtaagcctcaaattcttcatctgtcaatccacgaggatcgacatccggatgacgtattttcaataaatcaacaacattgataaagcggattttcaactctggaaacgcctcattcagcaggcttacagcagcgagagcttctaaatttggctctgtccctgctgcagcgatcaccaaatcaggttctccttggtctgttgaagcccaatcaatgatctttaagccgtcttttaccaatatctccgcttcttctgccgtataaaactgcggccgaggatgtttcgaagaaacaatcagattgatctgttcttcagtttggaatgtttctgccattacagccatcaagctattggcatctgctggtagatagacccgtacgaattccgcttttttctcagcgatatgtgtcatgatccctgggtcttgatgggtatatccattatggtcttgctggaatacggttgaggaagcaatcaaattcaatgacggataggcatggcgccaaggcaattctttcgatttacgcgtccacttaaagtgctgagtgatcatggaatcaaccactcgcaagaaagattcatagctagcaaaaaagccatgacgcccagttaagacgtagccttctaggaagccttctgcttgatgctccgataattgggaatcaatcacccgtccggtagcacttagccattcatcatagtttggctgttttggttctaaccattggcgatttgtcacttcaaaaacatggttcaaacgattggatttggcttcatccggaccaaagattctaaaattagtcgggttttcaacaatcaaatcccgagcaaactttccgaactccatcatgtcttgagcagtggttgagccaggaacaccaatatcgatcgcatgctgtcgccaatcggtgattttcaacggttgaggatcgattcccccgttagtgatgggattcattgccatccgttgctgtcctttcggcgcgagttcttgaatctcagccttgatgcggccagattcatcaaagagttcttctggcttatacgatttcagccaatcgattagtgcatccacgtgctccatctgatgcgcattgactgggataggtacttggtgggcgcgaaaaccgccttcaatcggctctccctcccaaatttttggtcctgtccatcctttaggtgtgcgcacgatcagaacaggccagtggggcatgactgcttcatcagcttttccttgacgagctttggtttgaatcgctttgatctgctcaacggcgcggtccaatgctctcgccatttgcggatgaacagtagcaggatcatctccctcaacaaaataaggtgtccaacccattccttcaaaatacttggttaggtcttcatcagatttgcgagccagaatcgttggattagagattttagcaccgttcagatgtaagatcggcagaacagccccatcatttaccggattgataaatgtattagaaaaccagctgcccgctaacggaccggtttcagcttcgccatctccaaccacaacagcagcgatcacatcaggattatcaaggacagctcctgttccatgcgcgatggaataacctagttcgcccccttcatggatcgatcctggtgtttctggtgccgcatgggaagcaattcctcctgggaaggaaaaaattttgaaaagatgctgcatcccggcctcatcttgggttacttctggatagatttccgtataacttccatctagataggcattcgaaaccatcacctgacctccatgaccaggtccttcaatgtagaacatattcaaatcatatttattgatgacacgattcaagtgggtgtagataaaattctgaccagcaatggtgccccagtgaccaatcggattgactttcagatctttttcttcaatgggccgccgtaacagtggattgtctttcaaatagatttgtccgacagaaagatagttggctgcccgccaccaagcattcattttgtcaaaatactcttgggtatcaaatgttgtctccatactactcctccttgctttctcttaattaaaagtctatgcgtctcgattttaaaagtcaattttgctgattgtacaccttgcatctctcttatgatttgtctgcttcagcacaagaaaaaacaagaccagagttcctcccaacatgtttcagtatgagagggtttggtcttgtcagtgttggctcttttctgttgtcttgtctacttttttaatagctacttgatcgtcacatagtccaaaccaacgagttttgcccacgtctcgatttgatctgacgtcaacgctaatgaaacaaccgtatgatgtccgcctcccgtttcgatccattgtttgactccttgatgaaagtcgggacgaggcgtccacatcacgcgagccaccggcaatttaggtgcggcttctgttggctcaaaagcatcgacttcattgatcaataatttatagtgagtgccaaagtcggccatagatacaactactcctgcgccaccttgtccgtcaaagactaatcgtgctgggtcttctcgatcccccattgatagcggcgaaacgacgatttttggtttattgacagccaatactggatccacttccatcatatgcgactgcaagatggcttctttgccttcggtcaactcataggtatagtcttccataaaaccggttgctttattatgtgccatgatcttcataagacgatcgatggctgctgttttccagtcaccttcaccagcaaatccgtatccttccgccatgagtcgctgtacagctaatcctggtagctgttgcatgccataaagatcttcaaagttggtcgtaaacgcactatagcctcctgcttctaagaaacggcggatgccgatttcttgtttggcctgtactttcacatgtgcttcccagattgcggcttcataatctccctgatcaaactcatacaaattacggtattcttcaaacaagtcattgatctcttcatcggtcacagcatcgattacttgaacaagatcaccaatgccaaagtaatccacggtccaaccaaattggatttgtgcttcgactttgtccccttctgttaccccaacattgcgcatgttgtcgccgaaacgagcgactttgatagcaaaactttcattgtaagcaaccgccacatccatccaagctgcgatttctttttggaccgtctcttttttccaataaccgacaacgattttgttttgtttctgcaaacgcgcattgataaaaccatattcgcgatccccatgggctgcctgattcaaattcataaagtccatatcgatggtctcccaaggaatgcgttcattgtattgagtcgccaaatgaagcaatggtttttgcagcagtttcgttccccggatccacatttttgctggtgagaaggtatgcatccaagtaatgacaccagctacttcatcccgataattgacttccttcatgatctttgtaatcgtgtccgcagtgactgccaattcttgtaaaacgactggataaggcagatttccactgtcattcaagcgtttgaccatttcagctgcatgatcgcggacttcttgcaaggcttcttccccatataagtgctgagatcctacaacgaaccaaaattcttttttactgattgctaacatattgtctgctccttcttgattatttttgcccatagtaggcatctttgccatgttttcgtagataatgcttgtcaaggatgcgctgcggcagttccggtgcataactattgatctgacgcgtcacaacgttcatctttgctacttcttctaaaacgactgcgttcatgactgcactttgagcatctttgccccaagtgaatggaccatgtccctgcagcaagacgccgggaatctctaaaggttggataccgcgttcctggaaagtttcaacaatcacgtttccagtctctgcttcataaccacggtcaatttcttcctgtgtcaaaaagcgcgcacaagggacactgccataaaaggtgtcagcgtgggtcgtgcccattgccggcaaatcaactcctgcctgtgcccaacttgttgcccaagtggagtgggtatggacgatgccgccaatttctggaaacgctcgatacaatacagcgtgagtaggggtatcagaagaaggattcatctttccttcaacaacgttcccctcaaaatcgcagaccaccatatcactagcttgcatcgtttcataatcaaccccactaggtttgatcacaaatagctgctggctgcggtcaacggcagacacattgccccaagtgtatttgatcaagccctgttttggcagagctaaattggcttggaagacggcttctttcaattgttctaacaaatgactcacctctatttttgttttaaatcaatccatcgatcgctgcttgctcgatcggcagaccgtgttggtagcgcttaacaaactcagtaaaaccaactatatcctcaggtaatggcgctaaagttgtcccttcttttccttggaaaactctggataaaaagactgtaagtgtttcttctaccgatttttttttcataaatgctgccagtaaagcgatgccccaagcaccaccttctcctgctgtttccatcaccgtcactggtgcttccatcgcagcagccaacacccgctgcgcaacagtcggagtcttgaaaatccctccgtgtcctacgattcggtcgatcttgacttgttctttagttaggatatccatcccgatcttcatcgcaccaaacgcactaaacaaatggagccgcataaagtttgctaaagtaaagcggctttctggggagcgaacaaacaatggtctaccagctgctatttttgtaatattctctcctgagtaatacccataagacaacaacccaccacagtcaggatctcctttcagtgcttggttgaacaatgtcgtaaacagagcttctgtgctcatttcgacccctgctgcttctacaaattcccgaaaaactttgacccatgcattgatctccgaagtacaattattcgtatgaaccatgccaactaaatctcctgctggcgttgttaccagatcaatttctggatagactttagagagaccgctttcaagaacgatcatagcaaaagctgatgttccggcagagacatttccactcctttgcgcaacactattcgtcgcaaccattccggttcccgcatctccttcgggtggacagaatggaatacccggcaacaatgttcctgttggatctaaccgcaaagcacctgctgccgacaaagtgcctgctgcttcaccagccactaagactttgggcaaaatatctgctaactgccaaggtaaattttctggaaggatcagatcatcaaactgggccatcatctgtcgatcatagtctttttgtaggctgtcgattgggaacattcccgaggcatccccaataccgattactttttcacctgtcagctgccaatgaacatagcccgctaatgtcgtcaaaaagttgacttccggtatatgcgcttcttgattcaaaatggcttggtacagatgagcgatactccagcgttgcggaatattgtattggaacaattcagttagagccttttcggctgcttctgtgctggcattgcgccaagtgcggaaaggcaccaataactgatcattctcatcaaaagcgagatacccatgcatcatagcggaaaaaccaattgaaccaattctcgtcaaaggttccccgtatcgggattgaacagaagctgctaatgcttgatagctttcttggattccttgccagacagatgccaaagaataggtccagacaccatctaataactgactctcccactcataactaccggttgcgatggtttgaaattgctcatcgatcaagacagctttaattcttgtggatcctaactcgattccaagtgccgtgcgcccttcttgaatcgcttcacttatttgctgctccatttctcttctctccttttgaattttgatatacatgaaatcacgaatggctcatgacggagccgcgaacaatcaattctggctcataataaaacgtttcttccaacgtagttcctgaggtgacccattgtgccgctaaaatccccatctcttcctttgggtgagccagtgtggttattcctggtgaagtcaatgtacttaaaggtgaatcatcatttcctacaattgaataatcttctggtacacgctttccattggcttctaattgctggatcaacccatgtgcaatttcatcgttataacagacgattccagtgatctcattcgattggttcaaccggtcaatcgcttgtgcaatgacagcctctttggtttctgtggtataagtcacgacatcttcagcagcaaatgttttctttgcttgttccaaagctttgacaaaacctttcatccgatatttcccttgtaaatcatcaattttagtgatcagcatcaagtgttgatgctgctgttccaataaataattcgtggctagatagcctgaacgagtgtcattgacacaaatatgaggcagatccagttcttcatagtaggcattgatcatcactagcggaatccctgcttctttcaatgccatgtagtaggccaaattgggattgtattgactgctcttcgtcggttcaacgattaagccatctactccttggtccatcatttgttgaaggcaagctcgttcttgttcatggtcattatttgttgatcccaacagcaaagaatagccttgttcccgcaatgtctgctcgactccgcgcataattgaagggaagatataatccgacagatacgtcatgatgatgccaatcgttttatggctgcgttgcggaagattctcaggttttgaaacgtacgtaccagatcctctttccttacgtaaatagccttcgtttactagcaaagcaatcgcttgtcgcacggtatgtcggctcaaatgatattcttcttgtaatacagcctccgaaggaatcgtcattccttctttataggttcctaaacggatgttttcccgtaattcattcgcaagttgttcgtacttcgttgtcatattaatcccatctttcgaaagttgtccgtacatatagtatatttggaatgcgctttcttgtcaatgtaattttgtaaaaatcaattttttacctgaagcagaaatataatagtcagtggcagcctctgctaaatgcacgattcgatcaattgcaactgttcagaaaagatgaattgctatacaataaatgacaacgacagcaaaggaggttcttcctattttctcttttaaagatattaaagaaaattacccaaacgctgctttgcatccagcaaaatcaacagatccaggaatcgaatcgattccatttggtcagaaattcatctggctgcctactgccgatctatcggcaaaagaaagaatcatgctgcaattaggcagcggtgcactgtttccggtaatcgacaaccgttttcgaccatggtacccgattttatttgaacatcagccgataaatgagaccggtgattatcgcttgttgcaagtgaaatttacgagtgggatcgatttattgcagactgagtggctgcaagagatccagcaaatgctcccccatgtcgtcgacctcttttttgttaccgaagacagtgcgttgattgttgaacagcgggctggtgagaacttgcgcttagatgaactggatggtttatttgttgctttagatatggattttgactgctactcgcatttatttgtagggccgtttcaccattcgagccatgatttcacacttctgctgactgaagaaatgactctttttcaacaattgactcgacaaaccaatttaaaaagtttggatctggctacatctctgatccatttgctaagcactgccggttccgactatcaactattatttcgaacactttatcaggattggtttcaggaaagcgatcttatccatttgatcgagtcgctgtggaaaaatcaaggaaatgccagttctacagccaagtcactcttcatgcatcgcaatacactactttataagatcgataaattccaaagtatgactaatctgaacttaaaagaaatggatgatctgctgctgtgctattttcttatcaaaaatttcgctcatccagccgattgaacaacttgcacaagaaaacgttttttttcttgtgcatatttccgttgctgaatcaaagcgttttcatttatgatacaggtgtaaactaaatggaaagaggtaatcctaatggtagaaatggctctgaaacacgtgcataaaaaatacgacaacaatgataattattctgtaacagattttaatttagatatttctgatcgcgagtttattgtttttgttggaccttccggttgcggaaagtcaacaacgctgcggatgatcgctggattagaagatatttctgaaggagaattatccatcggcggcaaagtaatgaacgatgtcgcaccaaaagatcgtgatattgccatggtattccagaactatgcgttgtatccacatatgacagttttcaacaacatggctttcggattgaaattacgtaaatacgataaagaagaaatcaaaaaacgggtagaaaatgctgccgagatcttaggattgacagaatatctagaccgtaaaccagccgcactatctggtggacaacgtcaacgggtagctttgggtcgtgccatcgtacgtgatgccaaagtcttcttgatggatgaacctttgtcaaacttagatgcgaaattgcgggtagcaatgcgtgcggagattgcgaaactgcatcaacgtcttgaaacaactacgatttatgtaacccatgaccaaacagaagcgatgacaatggcagaccgaatcgttattatgaaagacggatttattcaacaaatcggttcaccgaaagaagtgtacaactcacctaaaaatatgtttgttgccggctttatcggttcacctgctatgaacttctttacagttactttgaaaaacggcatgatctcagacggccatggattaaacttacgtattcctgaaggcaaaaacaaagtccttatcgaaaaagggtacgaaggcaaggaattagtctttggtatccgtccagaagatatccacagcgaacaaatcgcattggaagcttcaccagaagcaactgtccgtgcagaagtagtcgtttctgaactgcttggtgctgaaacaatgctttatacaaagattggttccactgagtttatctctaaagtagatgctcgtgacttccatcgtccaggtgaagtgattgatcttgctttcaacatcaacaaagcccacttctttgataagacatctgagaatgtgatcacgttaccttaatttgtagttttcttgcactgtccttggtttgccccctagacagttgcaattaactaatatccacttttattccttatttgtatcccctgaaaacagacagccctgcggctgtctgtttttgggtggattctctttaggtgaagggactactttgaagctctcttctcaagaaagcgtacataaaattttttgatcgttgggtattgacgatatgccaagaaaacaactttgattcttttagtagtaactgggtcgacatcaatgattttcttatacccgacagttccgcattctgctaaaaatcaatccttgccatctttttcataataaagtactgctttttcaattctctgactctcgcggatttcttcttgtaaaatcactgtattgatttgtgttggttgtgcaaaagtcactgttacccacggctcatgatcgttatccgcaggttgccaatacgtcttctttgatgaggtaaccttctgcaggctttcttgatcccagggtgatttttgggaagaagctgtgatctgtccttggtacaacggctgatccgtttgtaatggccgtagatattgccctaattgcatcagtgactgctgatctttcgggtggatcgccccattgggcattggcggaacatttaataaaaataccgcgtttcctcctaccgctttccgatacaaagaaaataatgtttcggcacttttcactgctgtatcctcttccggatgataaaaccagccgggtctgattgatagattgacctctgcgggataccagactaaatctctgctggaatcgtagtttctcaatacagatcggctacctaaatcttctgccatacttgagattgtcgtccggaattctgctgtgtctgtttgttgtgatttttcggccgtcttttcggcatccaatagctcacggggaacgacactccactcattctgccttgtgtgcccggcttcatttccgatccagcgaacatctggaccgcaaacggcaatcacagcatccggctgtaattgccgaatctgttgataatatctttgccagtcataaaactgccgctttccgttaggtccttctccattggctccatcaagccacacttctgctatttcaccatactgcgtcaataattctgtcaattgacccacatacacctcgttataggcctgtccggtgccgtagcctgcggcgtgctgatcccacggagaaagatagatgccaaacgccatccctgcttcttgacaagcctccgacaattctttgactaaatctcctttgccatttttccaaggtgtataagcgactgtctgctgcgaatagttgctgggccataaacagaagccatcatggtgcttacaggttaagatcatccctttcatcccgctgcatttgcaaagcgtgacccactctttacagtccactgcttgcgggtcaaatagtgctaaggattctctcccatttccccattcccgattcgtcatggtattcaagccaaaatgaataaagccataaaattcccgtgcttgccatagtagttgacggtaactcggacggatcgccgtcaattcttcaactttcatcgcacttcccctttctccaactgattgtcagcaaactggaacccattcagataagtgttcttactggcgatggctcactaaccgcagttgttttgtttttggtctttacagcaaatagagtagtagatgccaaatgaattgacaagccactactctaaattacatagtttagtttgtttcacatagtttttttccacaggttgcgttcaggattgcaacaccagaatagccgagaactaattcaactgcaataatgttaaactatctgctaagaccgcttcaccatcaagaagctcgtaatcttctggtgtgattagtttatacggaactgctttatagttcaaaaaatcttttaagcgattgatttcatatttcgattgtggtccaatcagtaatgcatcaacagtctgattttgaatgatttgttcagcaatgattgctggtgctgaataaatatggacagttattccttgttcatccgctgctcgctgcatgtttttcactaatagacctgttgtgatgcctgctgtacagatcaataagatcgtcttttgtgcttctgtccccatatttacagcctcctaagatattttctttttcttattataaatatctaagacaactgctaacagcaagatcaatcctttgattgcctgttgccagtcgacccctacacctagaatcgacatcccattattcagtactcccatcactaatccgccgacgatcgcacccatgatcgttccgattccgccagaagttgaggcaccgccaaaataaacggcagccatggcatccagttccatagaggttcctgcttgtggtgtcgcagcgttcaatcgtgcagccaaaaccaaacctgccaatgccgccatcgcgcccatattgacaaagacccagaaagtgatttttttcgttttgattcctgacagttcagcggctttcctatttccaccagttgcatagatttgacgaccggcaactgttttatttgttaagaatccatatgctgcgacgatgactcctaataaaatcaagatgatcgggtaaccctgataagaagcgaacacataagttgcgccaatgaaaacgacaccgatgaaaagagctttgaacaaaaaggtactggtggactctacttcaaacaaatttttcttgcggcgttcccgggttcgccattgaccaaaaatcaatagtgccgtgataccgacaccgataatcattgaaaggagatgaatatgatcgctgctgacaatatcaggtaaatagcctgttgaaattttttgaaacgaggtaggaaatggtgctaaagattgtcctcccagaacgacttgagtcaatccacggaacatcaacagtccagacaacgtaacaataaaagcaggaatccccacataagctacccagaaaccttgccaagcgccaatcaacgcaccaatcagtacacataatggcacagccacccagggactcatgccattattgaccatcaagacgccggcgattgcgccaacaaacgccatgacagatccgacagacaaatcgacatgccctaacaagacaactagtaacatccccgcagctaaaaccaatatatgactattttgcaaaacaagattggtgatgttcaatggtcgccagaaaataccatctgtcattgcttgaaaggcaatcaataagacgaccaggataataatcatgctgtatttgctaaaaatctctaacgctttgtctttgatagaatgtttttgcactttttttaatttattcgttgtttccatcctaaaccccactctcttctaatgtcatcaagttcatcagcagttcttgatccgcatcttgccgcaatacttctcctgtaaaacgcccttcattcatcgtatagatccggtcacacatacccaaaagttccggcagctcggaggaaatgatacagattgctttacccgcagatgccatttcttcaatgatcgtataaatttcatattttgctccaacatcgattcctcgtgttggctcatctaaaaataaaatatccggttccgtcatcaaccacttagccaaaacaactttttgctggtttccgccgctaaggctgccaacattttgatagattgaattggttttcgtccgcatttttttgcggtattcttctgccaaaattacttctttctctttgtccaaaacaccgttgcgactgattttattcagactagcaatcgttgtgttctcccgaatgtccatcaatagattaagtcctaatgctttacggtcctctgagacatacgcaagcccatttctaacggcagctggaacatcttttacggagatttgttgcccttctttatagacttcgcccgtgatattgctgccataggaatgcccaaagacactcatcgcaaattctgttcgtcccgcgcccataagcccagcaatgccgatgatttctcctttgcggatcatcaaattgagatcttcgttcacgattcgatttgtatcgataggatgatgaacggtccaattcttcacttcaaaaaaaggatcaccaatctggggatgccgttccggatagcgattcgtcaagtcacgaccaaccatcccgcgaatgattcgctcttcagaaatctgattgccagccatcgtttcaatggtttgtccatcgcgcaaaatcgtgatgcgatcggcgacattgactatttcattcaacttatgagaaataatgatggaagtaatcccttgattacgaaattctttgatcaattctagtaaattggcactttcttcttcattcagagcggctgttggttcatctaaaatcaataatcggactgatttagaaaatgctttggcgatctctactagctgctgctgccctacaccgatttgtgaaaccaatgtattaggatcaagacgcaagccaactgtttttaataaattatcggtcttcttttctgtgatattccaatcgatgatgccatttttggcttgttcatttcctaaaaaaatattctctttgatggataaataaggacttaaagccagctcttgatgaatgattacgatccctttttcttcgctatctcgtaaatctttaaatttacagagctctccttcgtaatatatttcaccttcatacgtgccatgtggatacaaaccgcttagcacattcatcaatgtagattttcctgcgccgttttcaccacatagcgcatggatctcaccacgttcgatcgaaagatttacattgcttaatgctcgtacgcctgaaaattctttgacgatattcttcatttcgagaatataatctgccatgtcctttcacccttttctttttatgtagtcagagattctgcagaagaaataaaatgatccattcaaaagaacggctctttgacaaacaagaaagaacagggcaaaacattggagtatccgctgatctgccccgatcattatcccttcagctgctcttttaccttttttgcgcttttgacagccccactgtcaacaactagcccagatctttttccgtgtaatagtcactgtccacaagctcttctttataattgctgctatctacagagactggattagatagataggtcggtaccactttgaccccattgtcataagtttcggtatcattgactgggacttcttcgccattggcgattgcttcgatcatttcgatcgtgtttttggctagaactcgggtatctttgaaaatcgtttgcgtttgttctccagcaatgatcgatttaactccagcaatggttgcatcttgtcctgtaattacaggtaatggtttttcagaagaaccataccccacaccttttagggatgagatgattcctaaactgattggatcataaggagaaagaacggcatctaatgttttatcggtatagttggcactcaataagttgtccatccgtgcctgtgcagtagaaccatcccagcgcagtgttgcgatttggttgaaattcgtctgacccgaaggaaccactaattgaccactatcaatatactgttgaaaaacagacatcacgccattgtaattgatcaacgcattgttatcatccggtgaaccaccaaacaattcgatattgaagggtccttttccatctttcaggcctagcttgtcttcaatataagaagcttgtaaaacacccacaccgaaattgtcaaaggttgcatagtaatcgacgtactccgaattcatcaataaccgatcataagcaatcactttgatgtcctcgttatgagccttttcgagaacatcggtaagcgcggaaccatcaatagaagcaatcactaatgtatcgacgcctttagtgatcatgttttcaatttgagcgacctgattctcaaccttatcttcgccatattgcaagtctgttttgtagcctaacttttccagttcatctaccatattgtttccatcggcaatccaacgttctgctgattttgtaggcatagcgattcccacaaaccctttgtccccgctgctggctccaccactatctgagccgtttccgcaagctgccaacatccctcccaagagaacggttgaagcgatacctacgatttttttcattgtgcttttcatttattgatccctccatacttttacttacaggctaagtatagaaaaaacagcaatcgcttacattaactatttttggtagtttctttgatttcttgggacattggaattcaaaccttgattttctttcgattaccttgttttttttcggaatcttgaaattaagaaaagcgcttacctttttttggtaaaatagaggtcgggggtgaaattatggataaaaaaaggttacacatcttcctttcgatcctgcttatgaccagtcttagcgcctgccaacgaccatctgaggggaccaatgaatctgctaaagagagcattgtcattggcttttcgcaatctggtacagaaagcagttggcgtaaacgtcatactgaatcgattcggacagagttagagaaagaagggtatgaagtactttatcgaaatggctatatgaatcaagaaagacagatccaagatatccgcagttttatcgtttaccaagtagatgcaatcgtctttactccattacaagaagatggttgggaaccaatactcgaagaggcggccaatgcaggtatccctgtttttatcgttgatcgtcatgtggatctggcagatccttccttatttttgacacatatcggtcctagtttcaaagcggaaggcaatcgagctggcctttatgtcagcaattatttcaagcatcatgaaaatgaaacgatcaacgtgctggagttgaccggactcagtgatacatcccctacgcaactacgttcagatggctttcgagaaaccatcaaacgagattatgcgaaaaacaatgtcactattcaagtaactgatgccttgaatggcgacttcattcgtagaaaaggcaaagaagtgattgaacaatatattgcagaaggaaaaatggccgacatcgatgttttattcagtcataacgatgaaatgactatcggcgcgttagaagccttgaaacaaacagatatcgtccctggaaaagacattgttatcgttacgattgatgctcaaaaagaaatgatcgacaatttgaaaaacggcatcgttaattgcgttgttgaatgtaatcccgatgctggtatcttcgttaaaaatgctatttcccgttatttaagtcggggcagaagtgcagttccaaaagaaatctatgtccacgagacagttttttcaagtgatatggattttgaccagattccaccccgaaattattaaggagtcattcatgaaaaagacaagtataaagggcatcttccaacaaaccaataaattgatgatcttagtcgcttttcttcctttattgatcagtagtatcttttattcccgccaaatttttatttatcaaaatacgatcaacaatattgaagaagccaatcagctctcgggtaaagtggatgcaattgttttagaagaaatgtgggatcttgtctttggccaaaagagcgtggcggatgttcaagtcaataacgtcattgaagaattgcgcgcggatcttgaccatatccaaacaaatacgaatacagccaaagaaaagaacacgttggctgttgccttacgtacactggattcattagaaacctaccaaaacaagctcatcgaaaatattgctaacgatgaaccactagaaaaaaatcaatatgtgatggtccaggtggattctgtaattgaattattatctgaaatcctgcaggaatttgttcgtgtagagattagtttggcaagtcaaaccaatcaagatttgattcaatctgtcttgttattgatcgcttttcaattgcttttgattcttttgattatttactttatttctaaaaatcgccgctttgttcgcgaaaatctccaaaatccattggatcgtctagtcgaattatctgatgaacttgcccaagggcatctcggctttcgagcagtcctgcctgatacaccggaattgcgcacattgacgagcagtttgaataaaatggcggatgatttaacccgtttattagaagagaatgctttgaaacaataccatttggctcaaagtgaagttcgtgtgttgcaagcacagatcacgcctcactttatttacaatagtttggatgcgatcgtctctttgatcgaagtagaacgatatgaacaagcaactgaaatgacgtacgccctctccgatttttttcggatttcactaagcaaagggcacgactggatccctctttcaaaagagttgcgccatgttgctgactatttaacgatcctaaagatccgttatggggagatgctgacctatgaaatcaaccagcagaccacttcccaagacctactagttttaaagatgatcctacagcctttagttgaaaatgccgtctatcatggcaccaagtttgtacgccgagtaggaaaaatcaccatcacgattcaggaatatgaacagacaatccagatgtctgtccgtgataacggtattggcatttcccacgaacgattaatggccatccagcataatctgaaagaaaatacagatcccgatccagaaaatgggtatggtctttataatgtttatcgtcgtctattactaaattacggtagtgacgtacaatttgatatcgcgagtattgaatcacaaggaacaacgatttcgatcatcgttcctaaaaaaggaggagcccactaatgtacaaagtcttcatagttgaagatgaacacctgatccgtgataacttgcggcatcagattatttctctagctgaaaaataccccattatttatagtaatgaagcggcagatggcgagttggcacttgcatcgattcttgacattcgtccagatatcatttttacggacatcaaaatgccttttatggatggactgacctttgccaaagaggccaaaaaattattgccacttgttcgaattatttttattagcggcttcgatgattttgattacgcaaaaacagcgctacaattgcaagctgatgactatttgttgaaaccgatcaaaaatgaggaccttgaacagacattgattaaagtcattgctgcattggaccaacagtcccaagaacaacactatctctcacaagatgatgaactcctgcgaatggaggtcagaaagaatctctttttgaatactcttttcgcaagtaaaatcacaatttcagaagctttccagcaagcgaccgagctaaagcgttccttttctggtaaacaattttgtgtcttgttggccaagacaccatacaatcagaatttttcggattatacccgcttcagtaagcagttgacttctacttatggttccgatgaaacagtcttattctccagcatttccagtcgcttcatcaaattcctgctttttgatttcaacaaagatgctgtactcgagaaagcctaccaaatggcacaagcgctcacccatgactcaagtgaggaagtggcagttgccctcggaccggtagttgagcggttttcggacattccaacttcctatcacaaagccaacgggatgttgaaaacgtatggcggcatccgcaaggaaaagatcattagctatgaggatgatatgaaagaaggagaattatctcctacgaatcctttcaaaatcgaccttgccgaacgaatctcccagactgagccagaggcgatcaatgacttagtcaatgaaatcatgtccgctcaaggaactgcagaaagaacccaaatgtatcgtttttttgttctggtagaattgattgcgctggtaaaaaagcgtgaaggcaaagaacaaaaggacttgctagctcaaactgcggatttagactatttatcccaactgacaagtgagccacacaactaccaagacaaagtgactgcactgcttacatacttagtcaagcagcaaatcaatccggcaatggcaaagtatcaaagtgtgatcagtcaggcaaaacagtttattgacaaaaatttttctgatccaaatatttcgttgaatgtcgttgcagaaaaagtcaacttgagccccgcccatttcagtacgattttctcgcaagcaaccgatgccacattcattgaatacctcacagaacagcggctttcattggcaaaaaaactactgatcacaacaaatttgcgcctttccgagatcgcctttgatattggttacaatgatccaaattacttctctttcctattcaagaaaaaagaacagatttcacccaaagagtatcgtcagatccaccattgacagaagttcaaaaaaaccagcccaaccttatacataaggctggactggttttttaggctagcaaataatgcaagaagcaaaatcgttgaacgaacaaaatcaatactggcgtcttgccttcagccgttcgtcattcttttttctccatcgccgcttttaatgctgcagccaatggactttcttgcggttcttcctgattgatcttttgcatcaaccggcgttcttcatgtttggtcaattttttgttacgctctttcttatctgccattttctcggtgatcccatcgaacttgcaacggaagaaagcaccattctttccttcaatgatctccatctttcgatgacattgtggacagcgatggttagacactttaggatctttacgacgacgatacttacaggtttgacttgaacaaacatagatcttgccatctcgggtactcttttcccttaatggttccccgcattcaggacatcgtttttgcgttaaggaaaagtcttgatatttgctttcgctttgcttgatttctttgactaattgcttggtatgtttttctatctgagcaaggaatttttgttccgagtattttcctttagcgatcagttctaattccttttcccatttctccgtcaattccggagtgactaaagatgggttgactagcaccaacaactgcttgccttttggcgaaacttgtaaaccgctaggtgttcgctccatcaactctgacttgatcaatttctcaatgatctcagctctcgttgcaggcgttcctaagctatgtttttccattttgcctaagagcgtaccttcattcaatggtttcggcggcgtcgttagttccttttgaatactgaatgttggtttgacactcatttgttcctgccaagaaacagtggttgcttcttcttttgactttttccagcctgcctcgatcacagtgttatgggtaaagacaaacacttcattaccaaatttgactgtaactttttgctgctgcttcttatgcggtttggcaaaaagcatcaaaaaacgttcaacgatcatttgatagattcgctgttcgtcattactcaatttttcataacgtgcccgttgctctgtaggcaacaaggcatggtgatccgtaactttcttatcattaaacacagcttgctgctgaacttgaccgccatttttcaaatagcttttgacttcaggagcaaaatcggccactgcttgcaaccgttctttcatcgttgctttcatgtcactggttaagtattttgaatcagtccgcggatacgtgacgattttatgggtttcatacaagctttggaccaatgacaacgtttttttggcagaaaagtcatagcgatgattggcttctcgctgaatctcggtcaaatcatagggtaaaggagccgcttcggttttgatcttctcttcaatagacgcaacacggccattttgctgactcatcttttgaaccagtgcttcggcttcgctacggtctttcaattgataaggattgctttgttgccgctttgctttactgtcgcccacttctaagttgatgacataataggtttgggggcggaaaccttcaatctgtttctcttgtgcgcgaaccaaagcaagcgttggtgtttgaactcggccagcgcttaaattatcctgatatttcactgttaaggcacgggtcacattcaagccgactagccagtctgcttttgcccgagcaatggcagaatgatacaagttatcatactgcttcgccggctgcaactttgagaacccttctttgatagccttaggggtctgagaggaaatccaaagccgcttgacaggtttgtcacagcggacccactctaagatccatcgggccaccaactcgccttctcgtcctgcatcggtagcgatcacgacttccgacacatctttgcgatgtgccagttgtttgattgctttcaactgatgccccgtcttaggcaatggtttgatcccgatcgttttgggaaccatcggtaatgtttccatctgccacgaggcccattctttgtttaaatcttcgggcatttttagacctaataaatgaccaagggcccaagtaacgattaccttgggtccttcgtaataatttttatttttttgattacaacccaatactttgctgaggtctttggcaacgcttggcttttccgctagaattagttgtttcataaaaatctttcctgctttcatcgacgacttgttggtattctttaagtagtgccaacccaatatattgttggagataatcgtcgcattcttcacaccagcgttcttcgtcttcattccaaaaagccgtcataaagttggtttttgcatttatgtacgaatactctttccgaatctcgtgccatttttcttcgtaaaatgactgtgcttccgcaaaagatgcaaatgtgaacgcctcttgaatatctgcctgccatccttcaaaaaaccaccatggctcgttatcaccatacatgactattacttgatacatcccatcgctcctctcaagattcctttcccatattagtcacttttaccaaaagttgcaaggaataagtctcaacaattaagcaccctttaaaaaattcaaaaaatcatcgtttttttatgtttttatactgtctcttaagatgacatcaaaatgatgttacccttagtctagcatagaacacagggaatgtgaatataacaagaaaagataacaactctacataggtgaaattattttacttggaaaatttttttatggcaagaacaattatgttacactaaacaaaaaatctgttaggagttggcgcgttgatgtaccttaatcaaattacttttcctgatcgtgaatccgaagggtcattttttgcggggattatgcgaactgtctatgattcctattacccctatcaagtcttgtcaaagaacgccttttctcaaatcgattttgaaccaatcactatcctttacggaggcaacggttcaggaaaaaccaccgcactgaacgtccttgctgagaagatcggcgcgcaacggtccgccgcttataatcgttccaacttctttgaagattaccttgatcaatgccattgcatagttaccaacgaacctaaaatcaagcaaattttgaccagcgatgacgtattcgactatatgctcgacattcgcaatttgaatcaaggcattgatcgccgccgagaagaaatcttcgacgaatattttgaagccaaatatgcaaattttcgttttaaaggctttgaagactatgagagattaaaaaaaatcaacctcgcacgttccaatacacaatcgaaattcacacgtaaaaatctgatggataatgtccgtgaattctcaaacggagaaaacgcggcaagctttttccaagaaaaaatcgtgcctaatggactgtatcttttagacgaaccagaaaattcactgtcggcccaacgacaaattgagttagtcgcatttatcgaagacatgacccgctacgaacattgtcaatttgtcatcgctacccacagcccttttgtcctctccatcaaagaagcaaagatctacgatttggatcaaaagccggtggatgtgcgtcgctggacacagttggaaaatgttcagacctactaccgctttttccaaatgcatcaagaagcttttgaagatgaaaaaagacgtaccgatcaataagaatctcctagaatcacatagaaaacgatccgaaagatcatgcctgcaaatccatacaggcatcactgatcattcggatcgtttcaattatcactgctgcaatcgttcgaatcgtttagacatattgcaattcttttgcttcttggtaagcggcatcgatcaagccaccgccaagacattccatgccatcataaaagaccactgcttgtcctggggtgattgcccgaacgggttcatcgaagatcacttcggcacggtcattatctagcaagcggacagagacgccgacatcttgttgacgataacggaatttggctgtgcacttgaattcacttggacgatccgtgtctgtcgtaaagtggatttgacttgcttccaaccgatccgcatacaatgctggatggtggaatccttgtcccacatacaatgtgtttgttgctaaatctttgccgacaacaaaccacggttcttgtgaagtgccgccgccaccgattcccaatccttgacgttggccgatggtatagtacatcagaccatcatgttgtcctttgacttcaccatctaatgtgaccatgttgcctttttttgctggcaagtaattgcttagaaattgtttgaaattcttttcaccgataaagcaaacacctgtagaatcttttttcttagctgttgctaaaccagctcgttcagcaatggcccgtacttcagatttttccatgccgcctaaagggaacatggttttactcaattgtgcttgcgacagttggctcaagaaatacgtttggtctttgttgctatccactccgcgcagcatatgggtaaccccattttcatacgtttcgacttgagcatagtgtccagttgccacataatcagcaccaagatccatggcataatctaaaaaggccttgaatttgatttctttgttacacataacatctgggtttggtgtacgtccagctcgatattcagctaagaaatattcgaaaacgcggtcccaatattctttttcgaaattgactgaataatagggaatgccgatttgagctgctactttagccacatctttgtaatcttccgttgcagtacatacaccattttcatcggtatcgtcccaatttttcataaagatcccgacaacatcatacccttgttctttcagcaaaagtgctgttaccgacgagtccaccccgccactcattccaaccaccacacgggtgttttcgttagacatgatttttcaccatcatttcaattatagattctgaaatcatctacgatttgaaggtcgcaacttttcagtaatttgcattatacaacagattggcaaaaaattcacggagagtttcatcggtttagcttttcctgtaaaaaacttagatacttctttaaattcaaaaaaacctttcccacataaatagttcctccgacagctgctgcttaagcctaatgctagcctgctttcaagcaaaaagaaactatcataaaatcgtatgaatttcttcataaaatacagaaatgtctgttgcaaggatcagctatactcctcttagataatgacaaaaggggtaacagaacatgaacaatcacgcaacgactgaccgcagaaatagaaaaaagccaaaaaattccgtcaaaaaaagtattcttgtcttactgatcattgtcgccggttctttccttttacgacaattagtctttgaaagagtaaagcattccgactcacaagatatcgtattattgccaaagaaattttcagagcaagccaatcaagtgctgcaagaagtgctgccgaagtcccaacaagtccctttgattttgcaaagagacgaacgttgggggatgaaacgttacggctctggggaacagcaaaatacctttgccgataatggttgtgccatcgcatctttagcaatgattgattctttttggcgaaatcaggcaccagaaccagacaatattctcaactgggcaggcaaccaattttatcttgctgatcaaggaactagctggcaaatctttcctcagtttgccgaacattttggctatcaattcttagatctgggaaattctttcgaggaagcttacaagatgattcagcaaggatttcccgtcattgtctccgtacagccgggaacatttactaccacaggccatttgatggtattggctttgaatagagaagggaggattcaagtgcttgatccaaatgattcaccagataaaaaccactacaaaaaaactttctctaatgaactgcttgctgctgaaggattgaattattggtgcttttggctttgattttcaaaagcaacttacagacttgcactgttgactgagaaccatcaaaaaaaaacagactagccgattagctagcctgtttttatatttgccgtaattattgaactcgtggttcgttgttttcttggatacggctggcagttttgttgaatgcgcctttggctttacgtgtttgttttgaagcaaattctccagttgtttctgcagcactgctaactttgtcttgaacagtttctgaatctttttcgaattgttcacgagttttaacatctgctacattaacgttcacttcgataacttccaagtttgtcattttgttgacttgtgttgaaacgacttctttgatttggtcgtaaatggcagtcatgtcgctaccgtattctgctacgatatctaaatctacggctacttgttttttaccaacttcaacgttgataccggaagtaacatcatccgtattcactaattttcctgcgatatttgagaagaacccaccatcaaccgttaatagtccatctacggattctagcgcaatcccgacaatcttttgaattactttatcttcgtaagtcaattctcctttaacacctgcagtagttgttggttttacttgattttccattgtacattcctcctatatcttcataaaaattataataataaatgttaccgatcactaacgccgcggcttttgaaattgatcaaagaaaccgatctctttgaggtagaagccaaggtaacctcctagtgctgtaaaaatcagtagtagcaatgttttcaaaaagccgactgtcagaaagagaattgctagtatcagtcctaatgcagcaaagataaccgggatcttattttgttcgaaccatttgttcatcatttctcctcctaaacgacacggggttgtgtgtgatgttctcttgtttcttcagcgtctttcaagacaacttctgtttgtatatcatgagtgacaccgaatagcgtttgaagcttactgctgatctcaccaaccaatgcttcttgttgttgcgggatggctgcggtctgtttcatttctccatcgatcatgactcggactttattcttgataatcttgaccttcactgatggcgaatggataaaatcagcttgttggacattctttaaaacaaaatgttccaaggctttcttttgaatcaccaattccccggatttttgctggataaccaaacgatccgaacgctttggaaagaacaagacaacgaaaataccaatgatcgtcagcagtgcaaagccgacacatgtccaaaacaaaaacatgctcatggaagctccgacccacggatactcacgcagtggaatcaagtagaatggtaaatctaccgcttgctgattctcaatcatgccaaagaaaaagacgagcaacaataacagtaacccaatgatcatgatcactttagaaatcttacgcataggcaacctcctttactactttctatttaaagcatacacatttcttaaatatccttcaaatgataaaccttgaaaccgattattttttcattctatgaccaatgttcagcttactagaagcagaaattttgtcttgctattataactattgttaaaaagatatatgactataattctttaaccgactgttttccttgttatttctcaatgaaacgtttggtgtatttctgcttgtttggcttgaaagatcctttctaattggttttcggaaattggtcgtccaaacggccaaggttgaggaaggaatgctaattccggcgcatcgacaccgacattgatattctcagcgataggcaaactatgatgatggatatgcccatgaaggttacggctattctttgtcattcccaatagcatcggataatgactcaaataatactggtgatgatcaaattttaacaacagaccgacatccgcaaaagaaaacttcggctctccggaaattccgggatcgtgctttgctagataacgaaagagtgcgcgcgtatcatggttgcctttgataaaagcgatctttccttgcagccgtactaatagcgctaaaagctctgcaaaccccgcttcatgttcgggatggagtgcaatatctcctagatggtagaccgtatcttgtgcttgaaccacctgattccaattagcgaccatgacttcatgcatctctgagacagacgcaaacggacgtggggcaaaatcattcgaacctaatagtttttcatgaaaataatgagtatctgatgtaaaatagcgcatcttctcttcctttctcagggtaaatgttttacatatctgtcagtatacgcttagcctaaaaagaaaacagcaaacaaaagccatgattgaagtcacgatctttccttcaactgtaacaaaaaaacaaccgaacgatttcatttctgccaaagagcaagggacaagtcacaacaacatccacattgatagtgtggaaccgctaacgtagtggattagcgctagcctccacactcgctactgtggacgatccaacattgtccacggaataatttgttcatgattgtcttccagatacacttttgaaacgaaaatcttttggttgcttttcctaaataacggatcattttgttcgcgatggtttacgctttgatgaataatccgcgactaataaacccatccatcaagaaataaaatttttcttgcagcattttgtgttgcgggtctttaaagatgttgactgctttcaatccattggctgtcgtaatcgacatcttaaacgttttgatgtcctttgcgacggtgatttttaatttaaagccttctttactttgcggagttgcttccaacccgcggatcagttggaaattgccactgtttgtttcagtaaatccattgtcccgcagtgtatacttttttgcttctggtgctaattggtagcgggtctctgcacctaagacagttgttgttgtttcaaatgccatttgctttccacctcgttcgacgttttgatttccgaaaaagcttctctagaaaaaatacaagtgcttttttctagagaaagtctctttgctatccggtatttctttcttcagattatcatgaatggttgcatgagtgccagtttttttttgctttctgctctcttttcgcttatctaggagcagccccttcgattcctctaaaaacacgaaactatgggtactacttcttcgttcctaaaacggttcgagcaagtaattctgcaaaactatggacctcttcttctgtgttaccaagaccaaaactgatccgcacagattctcccacagcgggatgctctttgccatacattgcttctaaaacatgagaaggttccacgttccctgcggtacaagctgaacccgtcgagatcgcaatgccttttagatccaatttcatcaacagtagatcactagtaacaccaggaaattgcagattgatgatgtgaggcagcttgctatcaggatctccatttaaacggtagtcaacgctttgctcttccaaaacagaaaaaacttgcttagcaaattgctgatacgtctcactgtacgcacgctgtacttctggagtcagcaaggaaacagcttttgccatacctacgatccctgccaaattttctgtaccggcacggcgcttttcttcttgctcaccaccgtgtaagagagtgggtagtgacaagccgtctcgtttgtacaagaaaccaacgcctttaggtccgttgatcttatgtgctgaaatactcaacaaatcgatgccatacgcagcaggatcaatgggcagcttgccgtaagcttgtacggcgtccgtatgaaaaacagcggcgtgttcttttagcagttcgccaatttcttggatcggcaaaatattgcccgtttcattattggcgaacataattgaaacgaggatcgtatctggacgtagtgccgctgctacttgttctgataagagctgtccttttttatcgacaggtaagtaagtgatctcgaacccttgcttctccaaaaacttcatgctttcgatgactgctggatgttcgatcgtcgtagtaatgatgtgttttcctactgcttgttttgcatacgcggtgccgaggatcgctgtgttgtcgctttccgttccgccactattaaaaatgatctcgtgggctttgacacctaactgatcggcgattacttgtcgcgcttcttctagcttggtatgggcatcccgaccgtacctatggatactggaaggattgccaaaaaatgtcgtcattgtgtcattcatggctcgaatgacagccgggtgcatcggcgtcgttgctgcatgatctaaataaaccattcgtttcacctatcctttattaaagccattataacaaatctaaaccaaccgtctatccctaacgattgattttccggtagtttaaaagaatagcaaaaaacagcaagcaggttttcttctgcttgctgcgaatgatttggttcttcaatgtatttttttagaaaaagtaatcacttatgcgttctcaccaggttcagaggcgatcaccgtcagttttccctgtaatgtccattttttgattggattaggcagaatacagcttgttcccatcttcaattcataggaatgaccatcgatcacaagttgaccatatccgtcaatcacggtcatcagagtatagtctgcttgttgttccagattcaatttgccacgaacttcccattcataaacattgaaaaattcggtttccagatacgtcacgattgccgaagatccttgcttgatttcacgaatcgacagttctggtgctttagcgggcacagtcgtcacatcaacagattgttggatatgcagttctctggtcttgccttgatcgtctgtccgatcatagtcataaacccgataagtggtatctgaactttgttgtgtttccaaaatcatgatgcctttaccgattgcatggatcgttccgcttggcacatagaaaaagtcgccttttttaacaggaactttcgttaatagatcatcccaacggccgtcttcgatcattgcttttaattcttctttggtttgtgcgtggtggccataaatgatctctgccccaggttctgcatcaatgatgtaccagcattctgtcttgcctagttcaccttcatgttccatgccgtacgcatcgtctggatgcacttgcacagatagatcgtcttctgcatccaagattttgatcagcaaaggaaataccggcgcctccgaatgaccaaacaattcttggtgatcccgccataagtctgctaatgtcttccctttaaatgggccgttttcaatcacgctgacaccatgaggatgtgcactgatcgcccagtcttcaccgatcttatcatttggcagatcaaaaccgaaaacagaatgtaaacggctaccgccccaaattttttcttgaaaaacaggtttcataaataatggttccatagttgatcccctctctattgattcgctaatattatagcacgaaaaacttcaacgaacggattcttttaaataactttgtacaatttgatcccgatgtttcagatagctgtctctgtgatcctctggatgtacgcgattcgaaagaaaaataaatgctttgccatcagaaccaatcaaaaggaaggtccctgtataccctgtatgatagaggtgtacaggcgtacctttcaagtcccagccgattgagcgatgtcctgtttcagatggcgtatggtctagatatagtctttccagtatatctgctgaaagaaaagattgcgtcgctgtctgacctttcttcaacatcatttgtacaaattgagtcaaatcatcaatggttgaaaacagccctgcgtttccggcatgtttgcccaaaactcgtgctttgggatcatgggtgattcctttcagaacagtcccatcttcttggcgctgagtggctgctaccttgcttgctgccggcaaaggaggaaacccactgttggtcatttctagcggttgcagaacctcctgctggaagatctcggtgacagaacagccaaaaagttcctccaacatgaagcctagaagaatcgtgcccgtatccgtgtactggacttgcttgtcaagctgtggtccgctttggactcgaagatacgcgtgacgcagctcttcagcagacaattgatcgcggcgaggaatccaagtctggatatcggaggtgtgggttaaaagatgtcgtaacgttactttctgatcagtaaaagcaggcaaatagcggaccagagggtcatcgattgctaggactccctgttcccatagtttgagaatcaccgtcgtcgtacaaaccactttcgtcaaagaagccacatcaaataggtgttccgtcgtaagtgattctatttggggctgccgagccgcgtagcctaaacaatgagtctccatttgctctccatggatgaatcgataaacaactcccggtaagacgccctcctgttgcttttcagcgattagccgaatcgtttctggatacataccagttcctcctttcgtgcgcctctaaactgttttgattataccagtcaggccctaattgcacaaaaaaatacagaagagatttccagagaaattcttctgcatcttagtggtgaatcgcattatttatttgcaacgaaccaccattcgatcccgatggtatcgtaggtagtcagtaagtttttctttttatcaataaagaattcttgcttgctgtcagtcaaatgagcttccaaagtcaataagtcttctttatcaatagcgatcttcaaaaagtccaatcccaatacctcatgtgtcggtaaatcgatggttccgccttggccttcgatcaaaccaacttgaaaatcatcttcattcaaatgtaagaaaccatctgcttctttggtcgtcaaacctaacagctcttccaaaaagtcgcgttctttcgctacatcactgacattcagatgaatttggttgaagcgagctttgcttgataacaggactacctcacttggtgcagcttcgatcaatgcttcaagcgtttttggcaaatctgtttcttgagtgccttcgtaaaaaacttcgattcggttttcttcaggatcagccaaaacaactgcgatttgacttccttcaaaaatagattcttcaaaagtcgcagactgttctttcgcttttttacaaattgctgccagttcttctaaggaagcgacggtcaagcggatccgttgcatttttttgatttccccaaaatgatcattggcccgtggactttcttctagccagatgacttcaccttctgcacctttgaaacccaaaatggctaattcgttttcttcccgtttcaaatcaaaacctagaacatcacgataaaaagcaatctctttatcccgatcttttactcgaatcgcgattgtccgcaactttgtgctcttccccaatacaaaatctgtcattatttctccccctatatatgtatgcgtttatctatgcatttgtccttattgtactgataaaccgttatactagcaaatgaaatcctttatcattctaccattatcaagcatttttttttgacaaaaaaatagatttaacgacaaaaaaggtcactgaacttctttttttgtggttaaatctacctttattcattgaaggaaggctgtttctttcattcttctgatctgagtaccgtttttttctaatcggtcggtgatactgacagttgctactccgctcataagcgcttttttagcactgactaactttggcaacatcccgccagtgatcaccttctcattgatcaatgtttttatgtcagtcaatgagacttgctgcagccactgggagtctttcttgattcccggtacatctgtcagcagaatcaatcgttctgctctcagactgctggcaactttacaagcgacttcgtccgcattgatattcagccactggccttcggctgtgatcccaagtggggcaaggatcggtatatgattgcctttgatcagcagctgaagcaactgctgattaatagtcttagccttcccaacatagccaagtgtggcgtgattgatcatttccccttggatcaactgatcacagccagcatttaagccgattgcctgaaatccagcttgctgaaaataagtcgtgatcattggctggacttgtcccagcaaaaccatgcgagtgatctcaagagtttgcgcatccgttaccctcaagccttctttgatctgaatcggcagtgacaatttctgcagcatttccgagatataatggccgccaccatgaacaatcacgattttctttcctagagcttgccattgtgcgacttgttcaaaaaaaacgggggtcagattatctgaagcaacaccacccatcttgatgacaatgatttccatatgttcttcctcctgttggatcttgtggcgattttttgattcttacagccaatgattccgattctattcgtttgatacctccatgagataggcattacgtatgatagagtgcattgattttgacataatcatacgtaagatcacagccccaagctttcccgcgaccggccccttcttgtaaaatgacattgatttttacttctgaggctgtcaagcgttcttccatcagtgtttcatcgtagtcaaggggggatcctcctgcaaaaaccgggatcgccgctaattcgatcgccacattggcaggatcgattctttgtccgctatacccaattgcacaaaggatccggccccaattggggtcttttccatagattgctgttttcacgagtggtgaacctacgatcgttttactgatcatgcgggcagctaagtcggtgggagccccttttgtttcagcttcaatcagttttgtcgctccttcaccgtctttagcgatggctttggccaatgtcgttaagactgtctgtagcattttttgaaattgcttataagcaaatgtattttcttcaatcggcggattgcccgcttgcccatttgccagcaccaataccatgtcattggtggaggtatcgccatctactgtgatttgattaaaagtgacttccgtgagttttcgcagcaatgactgcagaagggacggtgcaatagcgacatcggtagtgacgaatgccaacattgtcgccatgtttggatgaatcatccctgagcctttggcgcaacctgccatggtgacagtgtggcccgcaatctccgtctgaatcacttgatttttttcaacaaggtctgtcgttaaaatggccttctgaaatccggtaggactgccagaatgacttaattgacgaatcccagcagcaatcgttgccatcggtagtggtcgaccaatgattcccgtagatgccaccgccacctcttctgaggccactccggcttgtgctgcagccaaagcgatcatttctctggcatctgctattccttgttctccagtacaagcattcgcattcccggaattcacgatcactccccgaagctttcctgttttcaactgttctcttgttactaggacgggggccgcttgtacttgattggttgtgaaaactgcggcggcacttgccggaacttcagagaacaaccagccaagatcggcttttctttttttcaccccacaatggatgccatctgcataaaaaccttttggtgaaacaattgtccctataatttctttcatgttacacgctccttattctgaactaatcgaattcccaagtatcgttaaggataccaagggatctgtcgtaatccagctgtttcctccagcccagcccatttattgacgttctggattgcttgtccggcagccccttttactaaattatcgatcaccgcaatgactgtcacgatgtgggtcatcggatttaagaccaacccaatgtcacaaaagttggttcctgtcacctgccgcagttctggcagctttcctaacggctgcaagcgaataaatggttgttcttgatagtcttcttgatacctctgataaatatcttccgctgttctttctggcgctacaggcacataaagggtcatcatgatccctctgttaaccggaatcaaactagtggaaaattggatggccgtcaattctggatcccattgttgaaactgctggacaatttctgggatatgctgatgctgattcaatttatatgtctgcatattttctgaaattgtcacaaaatgactggtatctgacagttttttccccgcaccagaaagcccagatttgccgtcaaaaatgggaatgcctgccaaccattttcttctgactaaaggcgcagcggctaaaattgcggcagtggcatagcagcctggattggccattaaatttccgtgggacgtctgaaactctggcaatgcatatgttgcagcatgcaataaacgatccgcagctggcgtctgctggtaccattgctgataaacacctgcttctttcaaacgcagatctccggataaatccatcacaggaaagtcttgttcgacaaatggcgagaccaaatctttgctaataccagccggtgtcgcaaaaaagaccaattcattttcttgcataatctgcagcggatcaaacgggtaaatcctttggttgaccagttgctgcagatggggataaacattgactgaattttcttggactgaatgactatgtaacgttcctatctccaagacaggatgcaagtggatcaaacgaaccaattccaatcctgtatagccggtaaacccgacgattgctgctttcacttactacacccctttttcacttgttctcaaattctttttcaacaacctttcaacaaccaaagcagctcttctttcttcattctcacctttcagtggtttcttctttcgttcctaaaacatgacgtagaacagcgagtccttcagccatttctgcttccgttatggtcaatgctggcagcagacgcaggacattcgttccagctttcaacaccagtaaccctgcttgacgcaattctgtcatcgcctgttggagagcagtgctatccttcaactctaagccaatcattaggccctgccctcgaatagccacgatctgtgccagatccgttaagcctgccataagctgctgatgtctggcagcaacatttactaacacaggggaatcggttaggaccgtacatacggcatttgctgcagccatcgctaacaaattaccaccaaaagttgaaccgtgacttccagggccaaacccctgctgtaaatcagtttttcctagcatggcaccaaccggcagcccattgcccaacccttttgctaatgtaaaaatatcaggttcgatcccatattgctcaaaagcataaaaactccccgtgcgtcccattcctgtttgaatttcgtctatgatcagcagtgcacctgcttcttgacataacgcggccaccttttggacccattctttttcagctgggatcacgccgccttctccttggaccagttccatcatcaccgcagctgtttcctcatccaacgctgcttgcagcggggaaaattcattgaagggcaaatactcaaaatctggtacgagcggaccaaaatcctgatggatgctttcttgagccgttgctgtcatggcaccaaatgttcgtccgtgaaacgagccctcaaaagttaaaatctttgtccgacccgttgcttttcgagctagttttaaggctgcttcatttgcttcagccccactattgcaaaaataggcaagatatggaccttttgttagtttttgcgcgactgtctcttgtaacgaattggtgtagaggttgggcgcatgccataatttgtccgcttgctgcagcattgcctgctggatttcaggctgcccatagccaaggttgacgaccccaataccgcttgtaaaatctaaatatctccgaccttgagtatctgttacatagctgccctttcctgcagcaatctctaatggcaaacgtgtataattgggaaacaactgactcatccatcaacgacctcctatgaatatttatgtattaatatacatttttagcaaataaattgcaatatttatttattttataacgaaaatattcattccaacaaaaaaaaagagaagcttaacgcttctcttcattcttgtttatattcacaaaaatcgattgaataaaatcgttgtcttcttgtatcaggccgcatcatctgaaaattggctgttatacaagtccgcataaaaaccattcttagccatcaatgtgtcatggtttccggtttcgacaatcgaaccatgattcatcacaataatattgtcggcatcccgaatggtagataagcggtgagcaacgacaaaacttgtccgattttccaacaatttgttcatggctttttggatgagaatctcggtccgagtatccacactagatgttgcttcatccaagatcaacacatctggatcagctaagaaggcacgcgcgatcgtaatcaattgtcgttgtccttgagagatattgctagcttcttcattgaggaccgtatcatatccgtccggcagcttgcgaacaaagtcatccacgtgagcagctttagcggcttcgattacttgttctttcgtcgctttgtcattgccgtaatggatattgtcatagattgatcctgtaaatagccatgtatcttgtagaaccattgatatgttgctacgaagctcatcacgggtcagatctcttgtgtcccgaccgtcgtagcgaatactaccgccggaaacatcatagaatcgttccaacagattaatcaatgtcgttttaccggcaccggtaggtccaacgatagctaccatttccccagctttgacgtctagattaaaatcggtcatcaataagttgtctggtgtataaccgaattgaacatggtcaaaacgaactttatagtcgctttcttccacgggtaatccagaaggttcatctgacatttcttcttcatccaagacctcaaagacccgttctgctgatgcaacagttgattggatcgtattcaataaactagcaatttgagtgatcggttgtgagaattggttcgtgtattgcaagaatgcttgcacatcccccaaagtcatgttcccattcgctactttgatcccacccagaactgcgacaaagacatagcccaagttcttgatgaagttcatcaatggcataatgattgcggaaatgaattgtgctttccaaccagcactatacagacgatcgttttcttcttcaaatactttttgatcagccgcttcatggttaaaggttttgacaacggtatggccgccataggtttcttcaacctgattattcagtaatcccaagctcttttgttgcgcagcaaagaatttttgtgattttggtgcgacgatcattacgacgatcaagcttagcggcaccgttgctaatgcaaccaatgtcaactgccagctaatcgttagcatcatccacaacactccgactaaagtaacaaaactggtaataaattgggtcaagttttgttggagggtgctggcgatattatccatatcattgattgcccgtgacatgatatctccgtttgaatgggtatcatagtaagaaatcggcaagcgattcattttttcttctaaatcacgacgcagttcatagacggtccgttgtgatacacgggtcatgatgaattgttgcaagaaattgaaaatagcagaaataacatacataccgatagcgatcataatgatttgtcctactttatcaaaatcgatcggaaattcggtgacagtttttccagctttcatttgctctgcgccaatcataacacctttaaagatttcggttgttgcttcccctaagatctttggtgtttgaatctggaagattacggcggcaatcgctaaaacaaataccgaaatgattgcgatagaacgtttcgacatataaccgaaaagtcgttttaccgttccccagaaattttttgcttttggtcctttcgctccaatgttgcgccctggaccgccacccatcggtccaccgccgcgaggtgcttggtttttccgttcactcatgccacatcctcctctctcaattgagatgatacgatttcttgatacgtttggtttgaggccatcaattcttcatgggttcctttacccaccaattgaccttcgtcaaggacaaggatcgtgtctgcatccattactgtacttacccgttgtgcgactacaaccataatgctgttcttcatgtcttttttcaatgccgctcgcagctgtgcatctgtcttaaagtccagcgctgagaaagaatcatcaaacacatacacatcggcttgtttcactaatgcccgagcgatcgctaaccgttgacgttggccgccggagaaatttccgccgccttgttctacatgactgtctaagccttcgctcaattctgaaacaaactctttggcttgtgcgatttccagtgctttccagatttcttcatctgtcgcatctggtctaccgtatttcatgttttctcgaatcgtaccagtaaataaaaccgctttttgtgggacgaaaccaactgagtcccgcaaattatgctgtgttacttcagcgatattcactccattgatgcggatcgctcctgattcgatatcatagagccgaggcagcaaattgaccaatgtcgtcttcccagaacccgtaccaccaatgattgccacaaaatcacccgattttgcttgaaaatcaatgtcttgcagtgctaatttttctgcaccgtggtaacgatagttgacgtgatcaaaagcaagtgtggcttgatcaccttttaattgaatcatcttaggtgctttatcatcaacgatctcttcttcttcgtctaatacttcattgatccgatctgcagaggcttgtgctcttgggaccatcacaaagatcattgacagcatcataaaactgatcaagatttgcatggcatacgtcatgaatgcaatcagattcccaacttctaatgtcatttcagcaatataatgtccaccaaaccaagtgatggcaatattggtcccactcataatcaatgtcatcaaaggcatcataagtgccacgatagtatttactttgatggccgtgtgggtatagtctttattggcttcatcaaagcgattggcttcatacccggtcttatcgaaagctcgaatgacccgcactccagtcaatccttcacggaagaccaaattcagacggtcagtttttttctgcatgcttttgaaaagtggcacagcaaaatacatgattccaccaaccaaaacgatcataattggaataacgactaaaaagattttggttaactgagcgtctttttgataggccaagaagcttgctccgatcaaagtgattggtgcattgatcatcatccgcaagaacatttgtgccaccatttgaatttggttgacgtcattagtcgtacgagtgatcaaagaggcagttccgaatttatcaaaagaacgtgcggagaaattttctactttttcataaatatctgtccgtaatttttgccccaatttttgtgattctctagtagcaaagaatgtattgcctaatgcagccagaatactgatcagtgaaaaaccgatcattaaaaagccggtacgccagatataatcaatgtctccagttgcaacgccattattaatgatattcgacgttaatgtcggtaaatagagatctgctattacttgtacaaccataaaggcaacggccatcagtgccgaaacgagtgaaactcgtttaatcaactttgtcattcttttcccctctttctttttgtgcgccatctcttagccagctgattttgttattgaaatcagtcgttgctagcgaaggatcataggcatgattttctgctaactctcggtatgcttcagcaatcgtagaaaaaacggtgtgcatcaacagttggacgagcattttcaattcatgatcatccttgacccgtaataagtctttgtcgatctcagcaaaaaattcttcttcccacttctgtctcgcttcttgatgctctttgtgagagccgtagagtggttttttgtggatatccggcatcacttttcgcaaagaacgataatccatactcatgaagagattgcgataaaattttgcattttttccttctaacacttcttcgatcatccgagaaaaataccattcaaagccagcaaacagatcgcccttttcgtgttgaatggaacgaatcaaatcccgctgactgttttttttcaacgtatgaaaatagtagtagtataagtcttccttattttcaaaatactgataaaaacttccccgagggatttctgcgtctttgatgatattggcaatcgaagcatccttcaatgggacccgagaaaattctttcttagcagcgcttaaaatgcgtttttgcttatctaatggcaaatggaaaaacgtatccgttggcatcgtcatctctcctttcagttcaaatgataaatgacaacaattattatgacaggttgtcatatgacactgtgtcattatacacccctcatgagagaatgcaagtaaaaaagtttgaatattttatgaaagtcattttctttataaaaaggaaattcgcttagtgatttcatttcattgaaaatagattcattgtctttttctgaaaacaaaaaaagcagcggctattccttaagaaaggaagccactgcacaacagccgtttttcgattttaaataacatctattttttctttctaacccacaggacacagcctactccgactaacaaaacgactccaacgactggcaaaaaccaattgacggtctctcccgtttttggcaatgctcgactgtccgaagtagcactagctacttctgttttgctagttgttgtttgttccgacgaagtgttggcagcagatgtatcagaagattcggtattccccgttacttcagaagctgctgggagataatgaccttgattcacagcgtaaatgatccagccaatccgacctggaaacaatgtttctgaaccactggtagctacttcttcatctaagtgtgacaaaatcgatgtcaaccattcatctgaaattggctgttccggggaaatataaacaccatttgttgggtaaacaacttgcagatatgtttttaagcgatccagttctggaatcaacgctgcaaaagaagagtagctgcttggatcaaaggctagctgcggttcaatcttctcccaagataagagatgatcgataaaaagagcgcgaacgatccgagcaaaatagccgatatccattcccatcacatcttggctatatcgtaatgctagtgtctctgcatcttttaattgctgatcggtcaattgatccaactcatcttgcgtgaaagctgtcacacttccatcagtgatgcctctagtaaaagcagagcgcaaatcactttgttctgtaatggtttctgactcaggacttgcttgaacgcctgtttgagcgacaatggcttctaccacatcctcgggctgtgtcgtcacggattcactactttgtgcagtgtcagcggttgattccatttcagtattcgaaaccgtcgcttctgtcgaaatgatttcttcagttgattgcgtagattgaatcgtttctgatgattccgttgtttcctctgcaatggcagtaattggtaaaaataatagacagctcatgaaccagatactctttttcattcctttacctcctcaggattctcaggatttctttgtaacacgaatgtaacacaatagtaaattattcgcaatgtaaaaaggcacttccttaagaaatttaaaagatattcaatgtcttccgatgcactccgcttcttccctaacaaaaaatcccgaaccacttcagatgattcacattaacagaagcattaacgagatcatcattcagcagtacgggacgaagcgttcttaatcaccgaatgacacatgggtagaaaaaattgtaccattcgaatctagctgttttttaactatttgacttgtacagtcatcacaggactagcacttgtgactgttcctttagcagtcatggtttctgagataacttgttccatattggtgagtaccacaagcatatcagttgctttattgctagctgccaattctgccagatcaacttcagcaacttgtgtagcggcagtcacttgttgcccttcttggacgaggatattgaaaggcttgccttgtagctcaacggtatcgacacccatatgcagcagaatctcaagtccatttggtgtcgtgattccaatggcatgtttggttgggaagatcgttgttacagttcctgcagctggtgcatagatttttccatttgcaggagctacataatatccgtcacccatcattttttgagaaaaaacaggatcctttgactctgtaatcgcatgaacggttccttcagcaactgcatatagttcaatggtttcaggtgctgcagacgttgctggtgttgtagccgtcgttgaagtagccgccggtacttcttcatcaacagcattgacagcagctaaacggtctttaggaatcccaaagaagtaagtagccacaaagccacctgcatatcctgctaataaaccaaagacatagcctaaccaatgaccgttcgcaatcaacggaatcaaagctactccagaaggtccaatggcggtagcgccgatattcgacaatgcgccgataaccgccccaccgattccgcctccgatacatgccgtaataaatggtcggcctaatggcagtgttacaccgtagatcaatggttctccaatacctaaaatccctactggcaaagcgcctttgatcatttcagaaagttctttatcttttcgcagacgaatccacagggctaatgccgcccctacttgaccagcgccagccattgctaagattggcaataactgtgtgctgccagttgcttcgatcatttgaatgtggatcggtgtcaagatttgatgtagaccaaacatgaccattggcaagaaggttgctccgagaacaaaacctgagaatgcgccgccgacatttaatacccaattgattgagccaaccaaactgtctgaaataaacccagctaatggcatgatcaaaaagatctctgccaaaccgatcgctaacaaacacaaagttggggtaacgatgatatcaatggcttcaggaatcactcggtgcaaaacagtttccagtttagccagcaaccagactgcaaagatcacaccgatgatccctccttgtccaactgccagaggatctcctgtaaagaggttggtgattggggcttctggattcattccagtcaataagacgaccgacccaatgacaccacctagcgttgggttcgctttaaatacttgagctgcattgacacctgtgaagatcactaaataagaaaacatcccgttttttaagatatttaaaatcatgacataataattccacgtgtcgccatcgatttttcctgcagtgatcaagttcgtcataacagaagcaataccagcaacgagaccagcaccgacaaacgctgggatcattgggacaaaaatattcgaaatatctttcaataatgacttgattggtgattgtttttgtttcgctttttgagcagctttcatttctgctgctttcgcattcacagcctcttttccactggtggctgccacaggaatttcttgccctagatcaacacccgcttgtgccgccatggcatttgctactttattgacttttccaggaccgatgatcacttgcagttgttcatcgtccactactcctaagactccgggaatgttttgtaacccttgcttgctgaccttgttgtgatctcgaaccgtcatccgtactcgagtcatacaatgagtgacagaggcaacattctcgataccgcctgattcttgaaatattttttctgctagttgtgtaactgtcagttcttcttttgccattgattttttcctcctatccttctaacgttcctttaacgaacccttctgattgtaccagctttgcagcagcttcttctttttcactattggtaagcagcataacgatcgctaacttcacattttgatcggctttttcaaagtagtctgccgccgtttcataatctgcttcggtggcttgcatgatgattctcttggcccgttcaacgagtttgtcgttcgttggtttaacatcgaccattaaattattgtacacttttccgatgcctaccatcgaaatcgtggaaatcatgttcaaaatcaatttttgagcagtccctgatttcaatcgggtagaacctgtcagaaattctggtccgcaatccacttcgatcgggaagctggcatgttttgaaatttctgcttgtttgttgcaggcgatcgttcctgtggtagccccgatttcatttgcatagtctagtgctccaatgacataaggtgtgcggccgctggctgcgatcccaatgaccatatcattttccgtcagcttcaggtcaatcaagtcttgacgccctaattcaacagaatcttctgccccctcaactgctacagtcattgcttcttcaccgccagcaatcaaaccgatcaccatatccggtgagaccccaaaagtagggacacattcagcggcatctaaaactcctagtcgtccgctggtaccagcaccgagatagatcaatcgtcccccttttttgaaagattgaatcgtttgctgaattactttttcaatgcttggcaattccttttcaacggattgagcaactttctggtcttcggcattcattttctgacaagcctctgccacagtcatttcatccaagccaaatgttgcttgatttcgtctttcagtcgttaagttttctaaattaatcattgtcatttctctcatctctttctattttgaatcgcattcctgctttgatttgttggagcaaggggagatcttcttcaatcacttgcgcagcgacattgactttgtcatctgcgggcaggattcgcttacaaatttggatttcccccatatagcgcaagtaatcttgattatcgatagtcacagctccgacaacccgtttttgagcagtttctggggaaatcaatgggacttcagcaaatcgggcatttgcactgcgaatcacatctcttgcctcatcttgccggctctcatgctctcctaaaatatgttgataataggcagaaccaatatcctttgtgcgaagaaggacggtctgatcggctagataagaactgaattgcttcaaagaagcaggggtcacgataccatcaccaatgtagacagcatcaacggcacaatccctcaacaactccagtgctgctgcgaaggggctcatgctgcgatgcgcttccagtgtcggcaatccttggtaaagaggacctcttttattcgcatccccagcaacaaaggcctgtacaagaaaaccttgttgtttcaaccactgatttttggcctgaaaccattctttgtctaatcccgtctccggacgcggatagtaattgtgccacgcctctagattagaaaaatctgcctgataggtgttcaactcgttaatatctttttcagtcaatgtactcgcatttaaactaatagttattttacgagataattgagcaatggtctgattgtcgatcgcgtaatccattcgcagcccagtgactccccgatccgtcagttcatttaactctttataggaaaatcctgctttagccaatgcctctcctgaaatatctaccattaatgacaaccgattcttttttgctatttcaccaagtgttgtcaatcgttggcgataactggcggcatcatcttctggtatatgcatggatgtaaaaatcccagaaaaaccttgaagcgccatttcttcgatggcatcgatgtctgtggtagtcaaatcggcattcataaatactgaaaacccaaacattgttgattcctccttgctggtaccgttttctacaaaatgattatacaacggcctgtttgtttttgcaactatatttcgtaatatataattataaaaagaaatataatttcataacggtgtattttttaagaaaaagttgtcccttaaactttctaatgcggttcggccattagttgtggtacactttataaggagtcaacgagcgcgtaatttttacatagtaggaggaatcacatcatcaatgattacaatggatgatattattcgcgaaggcaacccaactttgcgggaagtagcaaaagaagtcccctttccattaagtgaagcggacattcaattagggaaagacatgatggagtttctagaaaatagccaagacccagtgaaagccgaagaattgaatttacgaggcggagtcggtttagcagcacctcaactagatatttctaaaagaatcactgctgttttagttcctagtagcgatcctgaaaatccagaacctgaatttaaagatgtgttgtacaatcctaaaatcttaagccactccgtacaagaggcatgtttaggtgaaggcgaaggctgtctgtctgtagaccgggaagtaccaggctatgtcgtacgtcacgcccgaatcacgatcagctattatgacatgcaaggcaagaagcaaaaagttcgtttgaagaactatgcagctatcgtcgtgcaacatgaaatcgaccatttgaatggtgtcatgttctatgatcacatcaatgaaaaaaatcctttctcattaaaagaaggaattttagtgatcgattaacgattagcaaacaagagcgcactcccaagtgggaatgcgctcttgtttactttagtcgtcattcattaggattaatttccctttgccaagctggcttgatggtccgctttgatttgagacaacaattctggcttttgataaagatctaatgcagtcaatgcgagtaattccgctgcgatcgcaatcgagttcagtcctttggtactacgagcagccgctttaaattcctcggagtgaccagcaatgtattcatccgaaattgagacagttggctggatcgtggggatcacttggctgacgtttcctacatctgaagagcctaaacttgcttttgtttccacatcgatctctgcttggggaacgccaacttcctgagtatgggcaaagaatagttcatcaaaacttggtgttacgatcacatcgtcgactgaattctggaagagtccaaattcataagtcgttcctgttgctaaagctgctcctttaacgatattctccactttctcatagacttcatctagtgtcgcccgattggctgctcgtaaataaaaacgtccagctgcatattctggaacaacattcgctgccacaccaccatcagtgatcacgccatgaatgttgacatctttcggcaaatgaagacgcaacccattgatcccattaaaaacttggatcaatgcctctaacgcattaatgcctttctctggtgccgctgccgcatgggatgcccgaccataaaatttgatatcgacaggatcattagccaaagatgcggtggttttgccatagcgataagctggatgcacgcacaatgcagcatcgacatcctcaaaaaatccttcacgcacaaaactgccctttgctgagccattttcgcccccctcttcaccaggagtaccataaacgcggatttctcctcctagttcatctacataaggttgcaacgcactagcagccaatacagaataagttccaaagagattgtgcccacaggcatgaccgatgccgggcagcgcatcatattctgccaaaaaagctaatgttggtccaggtttgccgctttgataacgggcatcgaaccctgtacgatgaccagccacttctttttccacggtgaatccttctttttctaattgggcaatcagcgcatctgcagaataaaattcatagttgctgacttctggatgatcatgaatatccaaagctagttcttggtattccggtaagcgttgtgcgataaattctttaatagaagtttttacagttgttgtcatatgattttctctccctttaatatggataaataagtatgaatagtcagtggtctcacagctcctgcctcagaaaggtaggcattcttgctatactcttctttacttcgcgccaaatgtctcccaggctggaacgctagaacctttcgatgtttcttcgataactttctttgtttcgtccgtttgataagcagcaacaactttttgatacacttcgttgtcttgatcttctttacgcgcagcaatgatgttcacgtatgggcgagccgtttcatctacaggctctaagaagatcgcatcttctgtcggaacaaagccagcatccacagccattccgctattgattactgaaatatcaacatctgataatgcgcgggcagtttgggcagcatctaactcagagattttcaacttttgattgttttcagtgatatccgaaacggtcggcgtctggcctgctgcttcatcaactttgatcaagccagcgctttgtagtaacaacaacgcacggccgccattggtgacgtcatttggaattgctactgtcgcgccttctttcaattccttgatatctttcaccttgtctgaataaatccctagcggcgcattgactgtattgccgatagaaacaagatccgttccaaactctttattgtaattgtctaaaaagaactggtgttgaaaagaatttatatcgatagaaccatctgccaacgccgcattcggttgattataatcagaaaattgaacatattctaagttgataccttcatctttcaaacgatctttgacatcatcccaaacatccgtgtcggcaccgatcactccaagtttgacggttacttctttctcttttgttccagcattgctattgctgcacccagtaataaataataatgccgcacctaccacgattgctttaagtaattttttcattttcttcctccaatagtttctacttaattttatttgttttttttgtcctttttagtggctgacttttttaaccaacagattgctgacaaattgactaaaaaagaccaaaattaaaatgatcagtgtcgccatgatggtgacgtcgttttggaaacgattatagccgcgggtgatcgccaagtttcctaaaccgccagcaccaactgcaccagccattgcggtcagtccaatcacattgatgatcgttaaagcagagacgcgaatgatcccagccaacccttcgggtaaatagacccgcacaataattcccaatggactggttcccattgcttctgccgcttcaataaccccaggatcaacttctaatagggcaatttcgatttgacgagcaaagaaaggaatgatccctgcaatcaatggaaccaaagcagctgtttccccaatcgttgttcctacgatcaaacgagtcgtcgttcctaacaaagccaataggataataaaaggaatggaacgtacgatgttgatgattttatccaaaagttcaaataatccgcggctttccaaaatacctcctggtcgggtcacgacaagaacaatgcccaaaatgattcctaaaatccctgcaatcagtgctgtccaaaaggtcatgtataatgtttggatcgttgcttctacaaattcatcagagatagcaacgacattgggaaaataccgttcaaaaaaagtgctcatctaaaatcctccttcaatcacgttattcaatggttccgcgtgattttgcttaatgatattcgtgtaaacaccttgatccgcgagaaaatctaatgctcgtttacgctgcccatattcccctgataaactaacgatcaaactaccgatgggaacatcttgcagaatctctacgtttccgtagaggatattcgtcgtaacttgataacgactaaacaattgtgcgatcaatggttcattggtctgatccccaacataagacagttccaccagccattcgttggcagccaatgaggagaatttcgcactgccgagaatcgtttccagcgcttgatcaatatgagtagcagtccgaataaagtcttttgtcagcggttttgccggctggctaaaaatttgaacactctttccttgttcaatgatctcgccattttccattacagcgactttattacagatttctttcaccacttgcatctcatgagtgataatgacgatcgtcaaccctaatttacgattgagttttttcaataatgcaagtatctgtaatgttgtcttaggatcaagtgcgctagtcgcctcatcgcagagcaagatctctgggtcgttggctaatgctcgtgcgatggcgactcgctgcttttgtccccctgaaagttgactaggaaacgaccttgccttttcttccagtccaaccaaggacagcaattctgtcactttttgacgacgttcctgtttggagattcctgcatatttcaaggaaaaatccacgttgtcaaagacattccggctatccatcaaattgaaatgctgaaagatcattccgatcgttttccttttttctcttaatgctttagccggtaatgcggtcaattcagtctgattgactacgacactccctgacgttggccgctgcaataaattgattacgcgtaccagggtacttttacccgcgccggaatagccgacgatcccataaacatcgcctttatctacttctagtgacacatttttgaccgcttggatcgtctccttgtttggttgtgtaaatgtcaccgatacatcctttaatgaaatcatttttttcctccttattatcgccgattgattaactagttgatttttggggatgatcaactacgcttcctccggtcaactactactgctcatcatctgctcgtctactctatgcttcgcctacagttgcttctaagctgacgctaagaagaacttgcatggtctttgaccaatcgcagtgattcggggtgaggttactacgctccctccggtcgcctagtactgttcatcatctgctcgggtctttgaccaatcgcagtgattcacagcaaaaaggcgtcctcaagcaatgaaattgagataatcaatgaatttcaatcagcgattcactcaaaaatgttgaactttgttttaaataatgaattcgataaaagtgattctaaaaacccacaaacaaacttactaaatcaattatcaaacatgaatcaaattaatttatttaaattatctcttgaagaactagaagcctatcatgagtatttacgagcgataaaaaaatatgctgatagcatcacatgaaaaataatttcacaattttcaaatagcttaatacttgaaatctgcccttttttgactaaaataataattgaaaagaaaatatagaaaggattgattattatgtcaaacgagattcaacaacgtaactcagacacatataacatgacacctttcaatttttttgaagactttagtcgtaatttattcaatgattttaagccaaatttaatcaaaacagatattcatgaaactgataatgaatattttgtagaagctgaacttcctggtattcctaaagaaaacattcaagttacttacgaaaacggagtattaacaattagtggccaaaaccaaattgataaagcaaccgaagataaaaaaggaaggttgcttcgtagcgaacgtagtttaacaagtgtccgacgtcaatatttattagaaaatattaaagaagacgaaataaaggcttcttattcagacggaattcttaaactaaccttgccaaaagatagtaacaaagaaataaaaaaagctattccaattgagtagtaattaaaaaattacgaaaaaaggcgtctataaaattttataggcgcctttttttcgtaaaaataaattattttttctttctccattcactatctaaaatcgaataaataatttgatcttgataaccatacttttccgataagtaattatctctaattatattaatatcatttggtgttgcagcacagaatttcagtctttcagtttcaaaagctatagcttgaaacatagtaccactccttttctatcatttttatataccaaagggcgcacttatacccaccaattttttcttacgaaaaattgataggtttgtgctaaaaaagagtacagatcactcacgtgaaactgtactctttttccgtcaagcgtgtttgttaaaattcgcttcgctcttgtctaaaattatttatcaaaaaattctttataactcatctttatcaaaaaagtaataaaaatcggtaaacaaaacagtcgttattgcttcttaaattcggctttcatatatcccatccattacttctgcacgaatgacatctagatccgttccacctgaattaagatatttcaaaatactccacaaagcatcatgcatatactcagcttcaattactaaatgttttttactaaaatcattatactggcttttatcaaaatcattattatcatagtgttcatcaaatattttcattttcattccctttcaattcaccagtttctaaatcgacatctaattcaatctcttgaataccatttttacgcgcttgatatgctccatcaaaataaattctcatcaaacccgttttagacacaataactttattaactactctcatactatttagcccataaatagacccatacttccttacaaatttacctaactctaaaatattagctatctgatatttttcgacaatttcacagattatttcaaaaagttcatccttttcttcgacgtcaagtgtattgtagcgatcaatatcaaaattattaaatagctttatatcagaactcttatatttatatttatttttagcaatagcatcttttgattcatgcgttaaatacaagtaagtattatgaatgcttgtagttataatctgaacagtattaacacttttttctcccaacaatcgtttgaatttcaggcgaatactatcagctgttacagggtttttcgaaacataaataccatgataatgcggctttttataatgcttgccatttctaacaacatcatcactcgcccactttgctttattcgttttttcatccatgtcatgcaatgggcttatcgcaatagggacacctaacaattccaatttttcttcccaatcttctggaatactttctggatacagaagaaaagtgaagtatctagccttttctttactcatttgctataatcaccttgacagaacaccaatagcaaaaactcgtttcctttcaaaaaaaacacgagtttttgcttattttttttgctctgcttcctttcttgcatattcctctaacgctaaaacaaagatagcagattttgagaatcccttttcctttgctattttttcaactagttcaaactgcttatcagtcaaaccaatagacactcgtttcttactttcagccatcgctcttcctcctaactacgagttttcaattattttactttttttacacattattgtcaattttttttaccaaataacgaaacacaacctaaaatgtcgctaaaatgtcgctaaaatgtcgccgaaaaattgcaggctgtaacccttatgagagtagggataaaatcgattttttaacaaatttggcactcggcactttatggggggtcgtagtacggaagcaaaattcgcttcctcgccccccattttttacaaattccaaattttttccaaaaattttccagcgctaccgctcggcaaaattgcaagcaatttttttaaaccataagaccatgagggaatttcattccctcaaactcccttgagcctcttcctaccgaaatagtgggctatcgcttattatttcattcagttatcggctttcataatctaacagcgaacctcttcactgcaaagccacgctacgctcaagggcttttacgttacgagaaccgctgttttaacgattatgccgacaactaaacgaaataaacgctaaaacgccttagaacgcatttttaggctgatacaggctttttaaaaacaaaacaatagaaatatacccataagaatcaaaacgccttagaacgcattttatgagctttaaaaatgatttgctttttattcgcacgtttacttttgattaaactagcaaagtctgtttaattaaaagtaaatgtttagttgagcaaagcgaaaccagaaaggagcaaacaacatgggattagattacagaaaaacatttgattctatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctccctgcagatacattagcttgggattttatattatccacatttgataatgtcacaattaaatctttatttgcacttgcagcatctttttgcattttttccattctaatagataattgcttgttaatatgcttaaagccaactaaatttaaaggaagtaatatcaataagagcaaaaaaattttccatgatataaatccaacaattcctagagataacaaaattacaaaacatgactttactatagtcgatacactattaatcaaaaataaatataaagaatccactgaagtaaatatacgattaattaaatacgtgggttctttttcaataaaaccatcataagaaattttagtcagcttacttatcagtttgaacaaataattcgaattaaactttgctgcaaaattttctctatacacgagcatgaaagtctgcaataagaaagaaaacaacataactataactataaagagcattatctcataggttagtttgatcttattttcattaaaatattgtatgaatagaggagtaatcattgatgttaaagagccaataacaactaatagactggttattaatacaaattgcttattttcttttagaacatttttcatattttttcctctttttcgttttatttttcataattgtactctttatcatttataaaagtcaattatttcccttaaattaggaaaaaatacgaaaaaacaaaacgacacttcaattagaaaatatacgaacacctgccttgaataaagcaactacaaactatttaaatagtacgtgtgggaaattagttggaagtgggaaattaaatagttacggaaaacaggaaaatggagagttattgcagaaaaaataaactagcataaacattcccagcttatttcgtattcagaccttgctgctctccagttagtcgtagttagtctatttactccgtatacggtgaaatcacttatctgattttataaccattactaagtacgattacttcatcaacaatttcaaggtttttcggacgatgggtaatcataaggacgatcctattcttaaatattttcattacttctttgagcaacttttcttcggttgattcatccaatgccgaagtggcctcatctatcactattatctctgcagtagaaaagaacattctcgcaaacgcaatacgctgcttctctccaccagaaatattagaacctttttcaccaattcgtgtatctaatccttcttcaagtgaatgataaaaatgtcctaattgacatttctctagtgcctctattacttgaatatctggtatatttttgtcaaaaacaatattttcttttaatgttccctgaaaaataggagcatcttgtgagagatagaaaatatgatcgtagtattcatttaaattatacgaagataaattcttatgattcacaaaaatatctccactagtgggtttgaataatcccaatataactttcatcaaagaagatttcccagctccactttctccaacaagtccaaaattttatctttctctaagtctaaattgaaatctttcaatattcgtttgttttgaatggttaaatttaaattggtcagactgatagttgctatggattgtataggtgctccttcgatgaagaggccttcatcatttgaagtatcataaaaatcttgtaatcgttgatatgtaactttatccaaatgatattggacaaaaactacattgaagatagcaattggtgtataaactctatcgacataagtaaccaacgcgactaatccacctaaactaatagatataacgtttgcaaatgttaatataacgatgactaatttaatgaccgcaactagaaaagcaaaaaagccaaagaaaaattcatgtatcattgtcatttttattaaattgtttgttgtagaaattgacatttcgtgatagttagctatttcttttttatagcgtttatttattcgaaaagtaaccatttctgtgatgccacgtattaaagtattattcattatttcttcagagattagtgagttttcttttatagcttttaatattttcaacaaatacttggttacaataaagataaaaatgtagccgattaaaatggctggaactaattttaaatcgattatcgctataaaaaacaaattaaaaaaagtttctggtattaactctctaaaaagtcttccgtaaaagtttaaatgaatgtttctaccagcgcttgacccagcttcaactttttgcaaaagcgagcccgaaccaatctttagatattccgaataggaaattctactaatcttgtctaatgccatttcttttaaataaaagaaaataccactttggagtttcattttaggcttttgttctagataagaaaatattggaacgaagataattgtcaatccataaatcactagatttagaataggcatgctttgaccaaatgcatctagcaacttttgaaaataaaacacattaatagcacttactaaagaaactgctacaccaataccgacataaactgagaactctattttgaagcgcttccaaatttttgtagtcatttttctccaccattctgatactaaaataatctgtttccttcgtttttcacatagtatgtatgcaactaaaattttacttcatggcgggatgaaattctagcaataaaataaagagaaatctgtacaaattatagatataatcacaaaacagcactatcattgaagctaaaaaatattattttgttttcaaacaaatccaattgcttgattgaaaagaatcaaatctaaaatcatcgatagatacactactgctgtccataatactttcctcatgtctgaataaaaatataaaagtttttctcaaatctatatcaactagatatagtacaactgcactagattttgttgtattcaccatgtgtgattcctatctgataaatcaacttagacctatcagattacgttatccaaaacttcatcaaataaaaaagggaaatcagcagttacctgatttcccttttttgatcaaacaaatcaatagtttatttcacaacaaataccgaacattttgcatggttgacgacatagtcagttgtcgatcccactacagctcttgtgagagttcctttacccgtcgcaccaatcacgattagatcaattggataagtttctgttgctgcatggatgataaatcgcttagggtctcctacctctacgatcaccgcaacgtcttcgacaccatggttatttgcatcatagattttctttagcatctcggtttcaaccctcgtcttttcctgttcaaatagctttgaaaaagaataagcactcgttgaaagctctgcattgttaatgattgaaaggacatacagtttggctttgtttcgtttgcaaatatcgacagcttcccaaaaggccttttctgattgctcagaaccatctaacgcaacgagaacattttgacatgtacgcaacatttttatcccctcctctttagtttaccacattcaagtgacagctgaaagattcatgaatgaactgctttgttatttttattttttctgttccaattgcatgcaatatatgtttttttacttcatttcccatgaataaaccttaaacatctacaaagatttctagaatttcattcaaacaggctctttcatgctagaatcatagtgaacaactgatttgaggtgaagacaatgcgtcaattctttcaagccctgttaacttttattctgtatattggtctttttttcgtgattctcggattgatagcctacttcttactacgataggaacgaaataacacctgagtctttgcatcttagcatttccatgttaaaataacaaaagaagcagtgtgcccttttagtcgtcttccccaagctaactatctggtccaatgcttttcgttatctgtttataagttttttatgttcaagtcaatcagccaacaaagaaaaatagcaattgcttttatagaaagaaggtactagaaatggagctaacgattaccacagaagcagcacaacgtcttccacaaggtacaactcaatttatcttgacagccaatgatggttccaaccagttttcctctgctgaaggctgctgtatgattggcgagcgtttcttgatcgcacctattgaagaaatcattgttccttttacattagagatccctagcaatttgtttactttctatacttctgagtacgacacaatgtttttaactggtcacctcgagttaatggtgcatccgacttccggcaccctcgttttgaaaaatgagagtggctatctggataataacgtcttagtcctaaaaactactaccatcaaataacattcatgagcttaaaaaagagtcgaagtaagtcccgctactaatcaaacatcgcggggataatcacctttcttcctctgttctaagctcttttttgcatttattttccagcatgatccattctgatcaattccagcaaatctaggggtttttctgccaaggcgactgctcctgcagaaagtagttcttcctcactaccaaatccataaagaacaccgatcgcggataacccattggcttttgctcctagaatgtcatggcttcgatcaccaatcattaaggcacttgtattgccatccgccttctctagtgcatatgcaaggactgccgctttttctccccgcttattttcaagatcagctccgtaaattcctttgaagtaatctgtaaaatctaagtaacttaaaatttcttttgcgaatatctctggttttgacgtagcaatgaagacatcatgtgtttccgaaagttcagccaaagtggtttcgattttttcgtaaggcgtaatctgaaacatccctttttctcgataattctcccgataatatttcacagcacgctgcgcagtctcttctgtaaagcctagatcacgaaaagaattaatcagtggtggaccaacaaaggctctcaatccatcggttgagagaggttcatgtcctaatttttccagtgcatagcgaatcgaagaatagattccttcgctagaatcaatgatcgtaccatctaaatcaaaaaataattgttgtttcatgtcatctccccttttccttattataggaaaaaaaggactctcccgcaaacgcttcttttttgaaacattcgacaaatcgactgatcttttggttcctcaaaatagttttaacttttatctgcaaaaaaagagcgatctttccgctagtagaaagaccgctccaaaatggcaaaaaaaagatagcttcacagctatcgataactccggcagtaggactcgaacctacgacatcatgattaacagtcatgcgctactaccaactgagctatgccggaatgaaacagcgtggcgacgtcctactctcacaaagggaaacccttcactacaatcggcgctaagaagcttaacttctgtgttctgcatggttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagccgaaaatagctgccgtaagcttatgttattcccaaagaaaaaacaaaccagttttactgacttctcaactaaaaaatcttactgtttatgacagaaaatagttgaaaaaagggtgaattctcattgtgtctagcgcgtttcattttcggcaatgatatccgtcactttcatcaagcgtgtcaatgttgctcgttcatcctctgctaagttgctctcaatgtattggatggtttctgtcaacttcggaattgtcatgtattctagtgcattgactcgccgacgagtccgttcgatttcatttgccatcagctgacaagttttttcaatttcagctaattgcagcatgactggcaaaatctgatccagatgggacagagaaagatccaactcacttgtcgtactaacaaaaccatatgaaaaatcatcatccgaactttcttcttcataaacaggattgagtaccggtacctccatgttcatcaccgtgcggctttgaacatctaacgtcactttgttcaaaggaatcataaaagcttcttgcaagatcacatcaggaatactactagatgccaaaacatactcttccattccagcttgtaacgctgattccatttgttggcgcaatttttgattttttttgactaactgaatgaattggcgaaccaactcatcttgtttatctttcaataacttatgcccccgagttgccgtcgtcaagcgtttgcgaagccgactcaattccatccgagtcggattgacattcattattgccatgaaggattcacatcctccccagtaggaagataggcttcaataaattcttctttgattcggctcaattcttgcttcggtaatgtagcgagcaatttccagccaatgtccaatgtttcttcaatcgttcggttggtatcaaatccctgatttacgtattctttttcaaaaagatccgcaaaacgagcaaatttcttatcaatatctgaaagtgcggattcccctaatacgatcgacagttctttggcagccttcccatcagaatatgccgcgtagatttggttcatcgtcgccgcatgatcccgccgagtcttgccttctccggttcctttatctttcagtcgggacaaactaggtagaatatccactggcggattgatgtttctcttgtaaagatcacgggaaaggataatctgtccctccgtgatatagccggttagatcgggtattgggtgggtcttatctccatccggcatcgtcaagatcggaatttgagtgacggatccttctttatccatcaaacgtcctgcccgttcataaagagtcgctaagttggtgtacaaataaccagggtaaccgcgtctgccaggaacttctcggcgagcagctgaaatttcccgcagcgcttcacaatagtttgtcatgtcggtcatgataactaatacatgcattcctttttcaaaagctaagtactcggctgctgttaatgccattttcggtgtagcaatccgctcaatggctggatcattggctaagttcatgaacaataccgagcgatccaatgcaccggttttgcgaaactcttctacaaagaattcagcttcttcgaaaggaatgccgatcgccgcaaaaacgatggcaaagttaccttcttgacttggcacagtcgcttgacgggcgatctgtgctgcaatttccttatgaggcaatcctgacgcagaaaagatcggcagtttttgaccacggaccaacgtattcaagtgatcgatcgttgagatccccgtttgaatgaactcatctggaaaatctctggccattggattgatggcttcaccattgacgtcaattcgtttttctggaatgatctgcggtccatcatctttaggcttacctagtccatcaaagacacgccccatcatatctggcgatacaccaagcgttaaacccgttcctaaaaagcgggctttactctcttctgcactcaggttactagtgccttcaaaaatctgtacaacggcataatcatcgctgacttctaaaacctgcccttgacgaacctcgccactgtccattcgcacttggacaagttcgtcaaatttgacgcttttgacattttctaccaccatcaaaggaccagcgatttccgagactgttcgatattcttttagcattaatgaattcctccagtctctacgattttttgtaataatgctttcgtgtcctgtttgattgcatctaaacgtgtcagttcttcttcaggaatatatttactgcgggcaatccgttctcgcagatcgatggtacctttggttatgtcatccagatacgcccctagctgcaaggcccgttttgcttgttcatcaaaatataaaatattttctagcattttaaattgcttatttcttgacgtataggtgtccacgtcatcaaaagcattctgctgcagataatcttgacgtaaagaacgagccgtcatcatcgtcaaacgatctttctgtgagagagaatccattcccactagctgaacgatctcttctaagcggctttcttcttgcaagatcgccattgcttcattgaccatctccgaccagcgaggtcccatcaactgatctaaataagaattgatttgatcttcatacaaagaataggagttcagccaattaatagaaggaaaatgccgcttttgtgccaacatactgtctaatgcccagaaaactttcacgatccgcaacgtgttttgagtaactggttctgagatatcccctccagctggcgaaacagcaccaatagctgtaatactgccctctcgaggctccgatcccaacgaacggaaccgaccagcacgctcatagtattccgcgatccggctgcctaaataggctggatatccttcatctccaggaatttcttgtaaacgaccgctcatttctcgtaatgcttcggcccatcgtgaagtcgaatctgccatgatcgctacactgtatcccatatcccgataatattcagcaatagtgattcctgtatagatcgaagcttcacgagctgcaactggcatatttgaagtattggcaatcaaaacggttcgttccatgatcgattcacccgtgtgaggatcgatcaattctggaaattcattgataacatctttcatttcattgccgcgttcgccacaaccaacatacacaacgatgtcgacatccgaccatttcgcgatttgatgctgaacaacggtttttcctgcaccaaaaggtcccggcacagctgccgatccacctttagctaccggaaagaaggtatcgatcacccgttgaccagtgactaatggttcacccggatttaactttgctgcagtcggtctaggcttacggacaggccatttttgcatcatagtcaagcgttgttcgccttctgccgtttctaaaagacaaatcggttcagtaatagcataattacctaccatgatttcctttacagtgcctttcacacctggcggaaccatcactttgtgttcaatggctgttgtttcttgaacaagtcctagaatgtctccagcttgtacgttgtcccttacttttacttgcggcatgaacgtccattttttttgacgatttagcgggtcaatggtcacaccccgttccaaaaaatcactctctgtttgattcataaaggtatctaatggacgttgaataccatcaaacatttctgtcaacaagccaggggctaattcaaccgataacggagcccctgttgattcaacgggttcgcccggtccaattcctgctgtttcttcatatacttggatcgacacgagacctttcttgatctcgatgatttctccaatcaagcctttttcactgactttacagatttcatggatcttagctcctgataaacctgaggccgtgaccaagggaccagatactttttctattgtgccaaatgccacatgcattcctcctagttgccgtacttctcttttaagaatctaatatattcattccaacagctttctcgacattctgctggatccgtgccattccgatccctagactccctgtactgctggggatggggatgatggctggcgtgggtagttcttcgtattgtcgaatgattgactccaactgttcaatcaatcgctcggtcaagaagatcaccccatagtcttctgccatttcctgcagctgttgtgcggcttcttcaagatcatctacaggatagatatcgattcctagacctttgaagggcaaaattgagtttttgccacccatcattgctatttttttattcatacgtatcacgcacccgacttcttaatatctcttccggcactttattgatttttccaatcaaaataatccgtaaatttttactttcgatttcttttgcatacaagtaaccgatcatcgcagctggaccgaatggcacgattttttgttctttcaattttcccatcaaaaagttatcttttcgcagatcaaacgtattaagggtcttcttctcaagcagttcttcatagctgtgattgatcaaatgtttgtaaggtgtattttgcagatactggacaaaagcttccaaagacgtcgtgattgcttccaacagctcttttgcagggagagtcccattatctgctagaacagcgctgataaagcctcgatgacgcttcatggcgtaactacgtagtgctgtcgaaatattaaaaatatctacttgccgttgaatgattccttgtaaaaacggatcatcatatcgcttaccaattgaccaaagatgttcccaaaaatgattgtcaaaaatgatatctacggattgaatctcatgataattttcgatataggaaaatacttcatcgatacaagcaatcattggctgctctgcgtgcgcactttttcttgtgttgaccaaatctttcaattcatttaaaggcatggttccgatcggtaccaaaaattcagaaaagtcttgtttcatgaatttagcttttactaacaccttcagattttgataatcatagcgaagggcaaaataatccaccacagaacgatcaggtgttagctgatacaagttttcatatactcgttttaattctgcggtcaatacttgttcaaaatcatggactcgatcttcttcattgataaaatcaccataaacggtttctcgcaaaagagcataaacttcttcggcactgttggcagaaagcatacgttcgtaacggctgcgactgatcaattccgcttcataggttcgtattcgtgtattcagcgtgttgtatttgatatcttccatttttacacccgcttactgttcaaaaatcaattgcagtaatgtatgactcaactcttctttgctggcatccaacaacgcatcaaacgtaaagttcagctcaatatcgcctcggcgcagtaaaaatccgccttttcgcggcaaaacttgttttgcaactgttagtcgacattcaggaatcgtttgttgaatctctttcaatgaaccttctgtcagcagatgcgcacttttttctcccaataccaattcaacttcaccaaaaacctgtgcttcttgtactccttttgtgacgaatgcttgaaaatcagcggcttccatttggttcaagcgctcaagtgcctcactaaacaattcttccaaaacggattgcttcgcggcaagcactttattgcgagactgaatgtgaatatcggaaatctgcaaatacatttctgcccgtttttctttttcaaattgggccaaacgatcagaaagttgttcttctagttgagaacgtttgagacgctcctgtttttcaatttctacttgtgcatcattaaggaccaactgatacttcttttcagcatctgctgtgattttttcggttaatcgcgtaatatcagacatctttctccccctcttaatttaaaactagcaagaaggaaataacgaaacctaagatacaatacgtttccatcatcgctacataaatgatcccttttgttacgtgctccggtttcttggctaaaatctgcatagcggcacttgcagcacgtccttgccatcttccggcaacgattgctgtcaacgcaataggtaaagaagcgataaataggtacattcctctatcaagggagatcgttccgctcatttgaccaaaaatcatgaatgatataacgaaaccgtatagtccttgggtacttgacaacagttccaagatcaaggcctgtccaaatttttctggttgctctgcagtcaatcctgcagcggcttcactggtcataccgaccccgatcgttgaaccgatcccaccacaaattgtcgctgtagctacacctaatgcggcaaaaaccaacccaccattttcataaaagaaactaatccaattttccattcttttcctcctgcattttctcttctgagataacttctacgtatttttcatcggttttgaaaggtacaaatgctcgtcccccaccggtgaaaaattttccgaaatattctaaatactgtaaacgaataccatgaacatacgcacttaaatagcttaaaaagatatttaatgcatgcagcgccacaaaaagcaaaataccgactgtgaaacgcgcagctattggtaaataactgatgatcaaattgaatgcggatgcgatactgcctcctgcgactcctaatgccatgagtcgtgtgaagctgatcatatcccctacgtaattcgtaacatccattaatccatatagtcctgagccgattttaccagctagtgttttgccttctaaactaccgccaaatacaactgcccctaagctagcgataatcatgataaaaccaatggtttgtaaaggcgaatcaggcaacagcaacattcctgctgccaatagaacaacactgatcaaaaagaccatccaagatccagcctgaaaaacagcctgtagcttctgatcttttcgtttccaaaggacataaaacttcaaagctaatccaaacatgatttggatatatccgaaaatgatcgacaagaccaaaatctgattgacatcttcttgggctgataacaattggaatgacaattcaaagccaaagaaattaccataaatcaagccccaaataatcgtgggaatcgaacaaagctgaaacagcgtcaaattttgttccaatcctttacttaaatgaaagaattttttgcccaagaatgttgccaaaaacagtaataatccatagccaaaatctgcaaccatcattccaaatgcaaccatataaaatggcgccataaacggtgtaggatctaattcatcatactggggcaaactatacatccgcactaacccttcaaagggttgtatccaccgcgaattattcaacaaaatcggaacatcctcgatttcttgttctttcacttgttggtattcaagataaaaagcatctttgctggcctgttggatccttttctccagttctgctgcttgctcaacagggatccagcctgaaatagctacggcatgagccgaacgaagcaacttttcattactctgagctcgtttgatcgcgccatctaaatactctgctacgagacgcaattgtccctgctcttcgctcattgcacgtaaggagtgtttgattgatttttcttcctcaatcaatgcgtgggatttttcttttacatgttgcaggtcatcttttggcagacctgaatagggataggtatactgctcgaatgcagtcttttttaaaagggaacttactttatctttaacatctttatggaaaagaacgaataagtatgtagtcgtttgtgattgataaactgtttcaaaataaacgagtggcagtttttcgcaaccctttgtgaaagccgcaaattctgaatttgggagcgaacctaataggccacctgatttttttaattcattcaaaatctgaggacggtcttcaaagtatttccatctattcagttctgcttcttgagccaaaagctctcgtttttcttgttcgatcaatcgtaaacgtttgtcttgttttcgaagtgtttgacaaacttcttgccaaggataagtatgagcggcttgcgctaattcgtgaagtgtgtagcgcttgattggttgccgaagtttttccagcattcctttttttggaacatattcctctaataattgcaggccccaatttacttgatcaaattggttttctacttcttcagtctgtttctgttcatcacgaacgggtgttaacacgcctgtggtttcctctgactcgtaatacatttcagaagaaagcaattcgacaccttgaaagtcttgtaactgctgtaaaacggcatctttttgttcgtaaaaggttaacaggctgaatttttgcatttttgcaatcgccatctatgtcacaaccttatttattattattgccaatgcttgttctctcaactcagctgaaatcgtgcgcaatgtctcaacttcctcttttgtttttgtcacaaggggttgttttgattgctcaaattccgttgcaactttttcttcaatcattcgttgtgcttcacgttctttttgtaccaattctttctggaatgctgaaattcttgtttgactttcatggatcagttgtttttttttagcttccgctttcgtgtttttttgttctgcaaagtcttctgcttcttgcagcaaacgaatggcatctacagacattctctcacctactttctactttttttcgcgaaaaaaaaccattacgaatcaagcgatcgctgttcgtatggtgttaaaatttaataagtgtcatctactcacacttacccgcgtcactaatataaccgtaacatatattttgtagtataacaaggtttcatctgtttttttacaatcattacatataaaatttaaattttttgcacaatttcacgaaaagtaatccctttcattataatggaggttttttaatcaaataaaaaaaagatgaaagaaaaatgacttcctctcatcttttttaaacgtcctaatttgtgatgccacctgttttttgctgataaaaaaacacttaaatcagctagtcattctatcaatcagctgtacgaataaacggcatgctcatgcagcggggaccgccacggccccttactaattcactacctggaatttgatgtaatttaataccggcctctgctaaaagttggttcgtaatagtattccggtcatagacgatcacttcgccaggcgcgatggctaatgtgtttgatccatcgttccattgctctctggcagctgccgtgatatcgtcgccgccacaacgaatcaactcgactgccggcaagtccaaataacggcataaaatgtgatctaacgtatctttttcttcaactactttgatttcttgtccttgctttgtaatagagaacaaggttagttcaccttctatttcagggtgaatcgtaaacttgtctttatcaatcatggtaaagactgtgtccagatgcataaatttccgttcagaaccaatatcaaatgctaaaatatgttcaaatgacggttccattgaaaaaatgttttcagcaattttttcgatagagtgcacttctgtacgctgagaaataccgatcgctaatacatgctgggacaaaacaagctgatccccaccttcgatacgtgcaggttcttctcgatcatacaagaaattgaccgatggcttggcgaactgcggatggtgcttgaaaatgtactgtccataaagcgtttctcttcgacgagtttcggaaaacatccggttaagagaaatgctatgtcctataatagcaaacggatctcttgtaaaataaaggtttggcatcggatcaataataaatggataatcattttcccgcattgctgagaaacttgcagtcttcgatatggaaagatcctgtttttttaaccccgccatcgtttgatcaataaacgctcgttcgtctttaatcgaaagaaaatagtctctgacttcatttaatacatcttgatcttgaattttcgtctcttgcaaataatcatccaagaaagcttccttacatcctgaaagctgtaatgtttcagcagccaggtcttctaaataaaccacttcacagccattctccactaaaacttttgcaaaaaaatcatgttcttgttgggcttgtgccaaaaatggaatatcgtcaaacaacaagtcttctaaataatccggcatcaagttttcaagttctgcaccaggacgatggagcatcacccgttttaacggttcaatttctgaaaatatttgtataggttttgacatatccaaccattcctttcgctcatttcaaaatgctgaagatgtgcataaatataaaagaacatctaataataatacagcttcattaagaattgagtgttatcaattatatttaattgtaggttgaaaataaaaaaacagcaagtaatatggttctcgtgtattgagatcggtttgaacattttacagatatttgtattatttcatgcacctttttgccaacgctttcagcttttactttttttgttatgattgaaacaaatatgtcttactacgagaaaggaagtttaacagatggttgatcaaaaacaaatttattacggcgcagattacaatcctgaacagtggtcacaagaaacgataaaggaagacatgcgcttaatgagagaagttggagtcaattatgtcagcatcaatatttttggttgggtaaacattcaaccaaatgaatcaacatttgatttcacttttttggattggctgatggatctcctttatgaaaacaatattgctatcgatttagccaatggaacagcttcgccccctgcatggttagtcaaaaaatatcctgaaatgatgccgatgaccattcatggcaatcggttggtacatggttctcgccagcactattgcccgacttcaccgatttatcgggaatatgcccgtcggctcagtgaagctgttgccaaacgatacagccaacatccgggagttgtgatgtggcatatcaataatgaatatacttgtcacatccatgaatgttattgcccaaactgtcgtgccagtttccaaaattggctagaaaaaaaataccaaacaattgaagcattgaatacggcttggtcaacaaaattttggagccaaacctatcaagaatgggatgagattttcctaccagaagaaatgccgacttttaagaatccttgtcaacagcttgattatcgtcgcttcatttctgatatgaatctggaaatttatcagatcgagaaaaaggcaattcaaacattctcgtcaaacatcccattcatgacgaatttgatgggtcttcataaatatgtcgatggcttcaaatgggcttctgaaatggatgtcgttagctggaatgcctatcctaatccgtttgaatctctgccctatccccaattcttagccaatgatctcatgcgaagtttaaaaaagaaacctttttttatcatggaacaagccccaagtgcggtcaactggcgccaagtaaacggcgtcaaaaaacccggtcaaatgcgcttatggagttatgaggcacttgctcatggctccgatggcatgatgttctttcaatggcgccaatcacaaggaggggcagagaaattccatagtgcaatagtccctcatggtgatccacacacaagtcgcacctttcgagaatgtgctgctctgggaaatgaattaaaacagttgaatgacatcgttggcagccggtttgttgccgatattgctatcgtatttgattgggaaaattggtgggcccttgagctagatgcgaagccgaataccaatattcgctatattcaccaaatgagggcgttatatgccgctctaagagcgttgaacattgctgttgatttcattcatccatctgaatcactagacggctatccccttgtgattgcgtataatttgtactctgcatcagaagaattcggcaataaagtcaaagaatttgtagcaaatggtggaacattcttgacaaatttcttcagcggaatcgtcaacgaaaacgatcaagtctatcttggcggctatccaggactttttaaagaggtattagggatcatagttgaagaatttcagcctttaaaaccggaaatccagcaacaagtgcattttaaaaataaattttatgaaaatcgtcagtgggaagaagtgatccacttacaaggtgctaccccactggctaccttcacgagtgatttccttaaagattcaccagctatcactaaacatcggtttggcaaaggactggcttattatttaggaaccgagttagaccaagaagggttgaccgacttattgaacgacatttttagtgatgcaaaactaaaaaaagttgctgagaggtatttgcaagaaaacagcgagttgtctgtcactgttcgacaaggaccaacccatatcttcttattcctacttaatcatacaaacgattcacaacaagtacaatttctatcggaaggtacagcattattatcaaaaagaaaagtttgtgaactcaccctcgcccccatggaagttgaaatcatcaaatttgccaagggctaaagaattgctttatcttttgttctattctttgtgataactccattctcagactttttcgatcgttccttcgtatacagatgaatgacccgattagaatctatctaatcgggtcattcattcgatgatttgcatgaaacagcaaattacataactactatcatttagtttttcttacagtaacaattgaacaagaaaatgccactattttggtgagtttcaatcaactgaaaacctgcgggactatccgaacgcccaatcctagatcaacaacttattgattactggaactgcattccgccatccacaatgattgtttgtccagttatatagttggcatcatcactggctaaaaatgaaacaactgccgaaacatcttcgggttcagataaacgtttcaatgcgatatctttactaaaagtttgcatcccccattcatcatctttaccagcattagcacctacttgatgcgcaatatccatcatcatcggtgttttaacaatacctggtgcataagcatttacagtaataccatagtcagctaaatctcgcgcagcgatttgggtcataccacgaacagcgaactttgagctactgtacaacatgagattaggattacccacaacacctgcctgtgaacaagcattgatgatttttccaccatgattcaacttttgaaatgcttcagaagccgcttgtgttccccataatacgcccccggcattcacggaataaactttttcaaactgttctggagtaatagactctatcggtgtagtcggtgctaccccagcattatttacaatcactgataagtcaccatagacatctattactttatcaactgctgaaaaaatctcatcccgtttcgaaacatctgctttgatagcaatcgcatgttcaccaagctctttcgctgccgctcttacagagttttcattgtaatccaccattgccacgtcaaagccatctttgtacaaacgcttagctatggcaaagccaataccttgaccagcaccggtaactaatgcaacttttttcattcattctcagctagtgaaaataaatacgcattctagtaaattttctaaaacagtaattcgcaacactttttctttttgctgataaagatcaatcctttcaaaatttaagaaagcacacatttaaataaaaaaagcatcaacgtattccttacgttgatgcttcattgttataccgacggccggggtcgaaccggcacgtccttgcggacaccagattttgagtctggcgcgtctgccaattccgccacgtcggcatgattgcagatcactcaagtacttactaaattttaacagctttttttatccaaccagttgatcttcaaccaatattaggataaaaatcgatacatcaatcgtacgaacgaatgatgtaccgataataccgacggccggggtcgaaccggcacgccctcgcgggcactggattttgagtccagcgcgtctgccaattccgccacgtcggcataacgcaaatattagtatcgtactaaggcggtaaccggatttgaaccggtgatgaaggttttgcagacctctgccttaccacttggctataccgccattatactatttctgcaatttacaaaaatgtaaatcgaactggggtagctggattcgaaccaacgcatgacggagtcaaagtccgttgccttaccgcttggctataccccaaaaatgaaagggcgagtgatgggaatcgaacccacgaatgccggagccacaatccggtgcgttaaccacttcgccacacccgccgtgataagaaaactttttaaaataataatggcaggggcagcaggaattgaacccacactaacggttttggagaccgctgttctacctttaaactatgcccctataaaatggaggagagtggattcgaaccactgaacccgaaggaacggatttacagtccgtcgcgtttagccacttcgctactcctccatggtggcgcgggacagaatcgaactgccgacacatggagcttcaatccattgctctaccaactgagctaccgagccaaaataacatggtgtatttacaataataatgaaacggtctggacgggactcgaacccgcgacctcctgcgtgacaggcaggcattctaaccaactgaactaccaaaccgtaatggaggttaacgggatcgaaccgctgaccctctgcttgtaaggcagatgctctcccagctgagctaaacctccgggtgttcattaaattgtaatgatccgtacgggattcgaacccgtgttaccgccgtgaaagggcggtgtcttaaccacttgaccaacggaccaagattataacggagagtaagggattcgaacccttgagacagcggtagccatctacatgatttccaatcatgctccttcggcctctcggacaactctccagcctaaaagaagctcaatacccttttttctcttgtaagagaactccggcagtaggactcgaacctacgacatcatgattaacagtcatgcgctactaccaactgagctatgccggaatgaaacagcgtggcgacgtcctactctcacaaagggaaacccttcactacaatcggcgctaagaagcttaacttctgtgttcggcatggttacaggtgtatccttctcgctatcgccaccacactattcaattgagtaagtattgctcactcaaaactggatcgaagaatcaaaactcttccgagtttccttgcttttttcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagcacaataagaaggatcacagtaagatggatcacagtaagatggatcacagtaagatggatcacagtaagatggatcacagtaagatggatcacagtaagatggatcacagtaagatggatcatagtaagatggatcatagccacatggatcatggcatgagtggaatggatcatagtatgcatatggggaatttcaaacaaaagttttggctttccttggttttagcaatcccgattattcttttatcccctatgatggggcttgaattgccttttcagttcacttttccagggtctgactggctagtgatgattttagccacgattttgttcttctatggcggtcagcctttcttgagcggagcgaagatggaactgcagcaaaagagtccagcaatgatgacgttgattgctatggggatcacagtctcttatgtctatagtatttacgcgtttatcgcgaatcatttcatgcatggcgcacatgtcatggacttcttttgggaactggcttcattgatcgtgatcatgcttttaggacattggatcgagatgaacgctgtgtccaatgcagggaatgcattgcaaaaattagctgaattattgcctgatgaagtaactcgcaaaaaggcagatggttctgaagaaaagataccactggacacagtgaagaaaaatgatcgtttgatcgtacgagcgggtgacaaaatccctacagacggtatcatcaaagaaggggcaaccacgattgatgaatccgcagttacgggtgagtcccgtagagtagcgaaagagtccggttcgaaggtaatcgggggttccgtaaatggaaatggaacgattactattgaagtaacaggaaccggtgatgagagctatctttcaaaagtaatggaaatggttcgtcaagcgcaggcggataaatcaaaattggaagctttgtcagataaagtggcaaaatggttgttctatattgcattggtcgtcggaattaccgcatttgtaatttgggtgttcgcagcggatttgccaacagcgctggatcggatggtaactgtttttgtcattgcctgtcctcatgcacttggattagccattccgttggttgtcgcacgttcgacatcaattgctgctaaaaacggcttattgttaaaaaatcgtaatgcactggaaaatgcccatgatctagactatttgttacttgataaaaccggtactttaacacaaggaactttctcggtcacaggaattgaaagctttggtgactatacagcagatgaactactagcctatctagcagggctggaacaatcggccaatcatcctattgctgatggcatcttagcgcaagcaaaaaaggaaaatgttcagccgaaggaagcgactggaatccaagcgcattctggtatcgggatcgaagggatgattgctggggagaaatggcagatcgtcaatcaaaaagggatcgaaaagtatcagacaaccattgatccggaccaattgaataaatatcaagaacaagggaacaccattagctacttggtgaaaggcaatcaagtcgaagggctcgtagctttgggagacaaaatcaaaccagaggcggtaaaattcatcgaaacattgaagaaacaggggattacaccagtgatgttaactggagacaatcaagcagctgctaaggcagtggcaacttatctaggcatcgatgagtattttgctgaattattgccagaagataaagaacgaatcgttgctgattatctgaataagaaacaacgggtagcgatggttggtgatggtatcaatgatgcaccaagcttggctcgggcaacgatcggtattgctatcggcgctggaacagatgtcgcgattgattccgcagatgttgttttgaccaatagtaaccctaatgatattctgcattttcttgagctggctcataaaactagacgaaaaatgattcaaaacctttggtggggagcagggtacaatattgtgacgattcccttagctgcaggaatcctagcaccaattggtatcattttaaatcccgctgtcggcgccgttttgatgtcactaagcacaatcgtagtagcaatcaatgctatgacactcaaaattgatgagtgacaaaaaaccgaatcgtttgtttccattgattctcttgtaagcaggagaacgaccgaaacaaactgattcggttttttagtcagttgagaatcgaagattctttggtaatttaacggcaaagccgtcgaaataaacctacaatcgaccagtgactttatgctataatgtgttcgttgagacaaggaggacgttgagaatggaactgaagaagttagaggttcccactacttcgatcactgaagtaaaaaaatctccgatggatgtatttaatcaagcgagagaagcgggaacagcagtatatgtattcaatcgtgaaaaagtggcgggggtcatgctgacacaagagcaatatgaaacactcttacaggaactggatcaacggccattagcggaagaagagccggatcaaccagctgtggcgggattggaagaattcttacagattatgcggcaagcattgatcacaggggcaacgatttctgcaaaaaatttggacgaacgaatggtcgcattaggctttattacccgcaaaacaggctttggcggtgtagttgacatgatcaatgaattaaaagaaaccggaaagattgtctatcaattgcgcaaaaagcccgatggaaaatctgtcagtgccgaagtcatcggcgagcaagacaatcaaacgcagctttttgataaattgatcatcaaaaaaatattccttaaagaaaactaacagttatgctgcagcataactgtttttttgcgtaagtgtaatagtgtgagtttagtcgataccgatagaaataatggctgagacaaaaggtgtgaaaaggatactcctgattaggatcaaaaagtaccatcagataacagctaagtctcagcctttttcagcgacccactaagcaaccgtcaaccaataggttttaccatctttggttcgctgcatgaatccgtattcgatcaaatagcggcgaacagtgacgtagtcagcaataaactgtttcaaaatatcattgacggcactttcggaataatttttctgagaatcaaatttttgagccaaaacactcaataccacgattttgcgtttttccttacttgggaattgatgaatcaccccatcttgatcgaagtatgtcgcaatgattttttctctttcttcgctggtgattgcataacgatcatccaacatggttgctcctgtatggggaagaacaaaatcttgttcctctaaatgtgccataatacttaaaaagactttcgcttgccgttctttttcttttaatttaaagcggtgatttcgtactgtcgaattagagatacctagacgttgcgcgatgacggcatcgctgagtccttgcgcaaataatgataagatctcttgttggctttctgacaaacctgtctgctcgcgacttaatgacagcaatgcattcagtaaaccaccatggacctcatttagatgtaataagatgcattttttggcggtataaaagcgatcagaggttggataaatctgtcctttttcataattaacatcgcagaataggcattgataatgtgtttttgtggaacgatacccatgttcatagtcagacaaagaggtggcgggaatagttttcactttaatcatctccttttgtttgtttatatactaacatttataaatatcgtttgcaaatatataaacagatggattttttattttttgttttagcgaaagtattaaattacggatcaaaatgtgataggattaacagcaataacaaaaggtaactttgtgtggataggagtgatacgatgacagatgtcagtcaacgttttaacaaagaagtctatcaaattgctgtttctttgattcgaaaatttgatgagcgggtatctggtataccagatattttgaaattaacattaggcgaaccggatttcaatacaccggatcatgtcaaaaatgctggtgttcaagcaattgagcaaaattacagccattactcaggaatggccgggttaacggatgttcgagaagccgcaagcctttttttaaaagaaaaatatcaattgagttatgatccgttatcagaagtattagtgactatcggtgcaactgaagcaatctctgcttctttattagcaattctggaaccaggagataaagtccttttgccagcacctatttatcccggatatgagcccgtgattcaactagctcacgctacccccatttatttagataccacagcgaacgattttgtattgtcaccggagatgttggaaggggctttgattgagcatggggatcaggtcaaggcggttatcttaaattatcctagtaatccaaccggcgtggtttattctcgtgaagaagttcaagcacttgcggaagttctgaaaaaatatcctgtgtttgtcgttagtgatgaaatttatagtgaactttcttacgacgcacctcatgtatcgatcgcagaatatttaccggaacagaccattttgatcaatgggttatcaaaatcacatgcaatgactggctggcggattggttttatctttgctcccgttgccttaactgcccaaattatcaaagttcatcaatatttagtaacggcagcctcaacgatttcacaaaaagcagctgtaagagcgttagttgaaggaatcaatgatgctgcagttatgaaagccgagtaccgtcagcgacgtgattttctctatgaaaaaatgacagcattaggttttgaaatcgccaagccgtcaggagctttctatttatttgcaaaaatcccaaccggttatgaacaagattcgatggcattctgtgttgatttagcagaaaaaaatcaattagcaatcataccagggattgcattcggacccgaagccgaaggatatgtacgcctaagctacgcagccagccaagagaacctgcaagaagccatgaagcgactaagtaattatatgaagaaacaaccaaatcaataaacacatcagagcgtcccaatgggacgctcttttgctgcgaatcactgcgattgacactcgaagagtggcagagcagatgatgagcagtactaggcgatcaaagagagcgtagtcacattcaaatgaatcactgcgattgacactcgaagagtggcatgtaagttcgtcttagcgcaaacacgctagaagccagtgcgaagcaaagtaagtgtagccccaatatggagtcataaagaacaacacacagcggcacttgtaccttttgctttttaagaaggaaccaggcaagctcttttcacttcaatgaaaagagaggaacaatgacgagcgatacattttaatgtttacaaaagatttacatgggtttatctattctttactttaaatcaatcatgggtttacaaggggttgctaaactaagcatataacgaaaggagatttaacaaatgaaaaaactgggattcttaattttagcaacaggactattactagctggctgtggaaatagcggatcaaatgctgctgatagcggtcaagcatcaaatgaatcaagtgcttcaggagcagcgtctggaaatgtagaaattttggctgttggatcaactgcactacaaccattagttcaagctgcacaagaaagtttcacctctgaaaatccaaactatatgattactgttcaaggcggcggtagcggcacaggactgagccaagtagaagctggtgctgtaacaatcggtaattctgatgtttttgctgaagaaaaagacggagtagatgctagcaaattggtagaccataaagtcgccgtagttggaatggctcctgtagtgaataaagaagttggtgttaaagatatcagcaaacaggacttgattgatatcttcactggtaaaaccaaaaattggtctgaacttggtggaaaagaccaagagatcgcagtgatcaaccgtgcatctggtagtggtacacgggcaacatttgaaaaatggggacttgacggggccgaaacaattcaaacccaagaacaagactcttctggaacggttcgcaaaatcgttgcagaaacaccaggagcaatcagctatcttgctctatcttatctggatgattctttacaagcattaacgattgatggtgttgaagcaactccagaaaatattgctacaaatgactggaaaatttggtcttacgagcatatgtatacaaatggcgaaccagatgcaaacgtcaaaacatttcttgattacatgttgagtgacgatattcaacaaggtgtcgtgaaagaattaggatacttaccaatcacagaaatgaaagttgaacgtagtgttgaaggggaagttacgaatataaactaagaaactatagttatcaatgaatagtcagagacgaaaagggcaaataaatgccctttttttctgtgtttttatgcttttttcctataaaatgaaaaggagtaaaattgaaaggggaaaaaaatgtcaaaacagacaaaatactttgtatatatttgtgcacttttgccgctactgtttttaggaaatacaggaactgttttagctatagaaattgaaagcagcagtcaaacacttactacagaaacaatgaatgaaacaagtgcctctaacacctcaacgacggatagcacaagtaccgtgtcgtcagatgcagagggagcttcgaataccagtagttcagaaaagagtagtcaagaaagtacaaaagaagaaacacaagcttcagatgaatcacagcaagaaacacaagaagaacccgaaaaaatttatgatgttcaaggtggacttgatccgtcgagcagaaatcgttccgatttgaaagaacaggtgggcattcagcggcgttctctgcgttcagcagacgtcgcgtttattgaagccggagacccatcgactcctagtcaggattttattgatgtctcttctcacaatggcatcattagcgtggaacaatacaagattatcaaaagttatggtatttcttccgtggttgtgaaattgacagaagctacttcttatcgcaatccattagcagcatctcaaattgcgaatgctcaagcggcaggactggtagtacatgcttatcattacagttggttcacgacagaagcgcaagctaaagcagaagccgagtattttgtcaaatatgccaaagaattgaagctgccaacctcagctttgatggttaatgatatcgaggacaatcaaataatgggaaaagcagatcatactgcactttctaaagtatttgccaatcgtatcaaagaattaggctatagtaatacccatcattacactggggtactttgggtcactcaaaaagcgatcgatcctgctgcacttggctatagtaatgtctggatcgcgaattatccgtatgttcctgcaggacaaaaattcacggaatatagtgcatggcagtggacctataatctttctttcccaggagtcagtgggaccttcgatatgtcttctgactatcagaaatactttactggtcaggggcaaggaggagcaataccagacaaccgctacgctacgattacgaaagataactacacgatttggcagaatttttcttggaagaaaaaagcagattcaaaagattatttgggtcaaacgttacaaataaaatatcgttacgagcatatcaatggtagtacgtatttttctgtgtacgataatcaaggtacttggataggttatattaatgctggtggaactaagacaactgatggcgcacaaggaagttggcagtcaaaagaaacgtatgtaaagtttcgttcgaccggaacggtttatcgcaattttaatttcgattccacagcaatagtatcagaagaaatgttgaggaatctttacaaggtaacaggcacctatcgtcattttaatggtgtcgtatatgattcagtatatgatctcaatggtaaatggatcggttatatcgattctgcaaagcttagtgtggagaatcaaggtccagctattagcgacgaacgctatacaacagtcactagtgcaaattactcgatttggcaaaatttttcttggaaaatgcgtgcgtcaagtagttcttatttgcaccagacgctaaaaattaaatatcgttatgagcatttgaacggcagcgtttatttttcattatatgacaatcaagacaattgggtgggttatattaatgcaaatgccacgaaagttgccgacaatgcagcgggtgctgtgttattcagtggacaatacggaacggttactagtaaaaattattcaatatggcaaaatttttcttggaaagaaaaaaataaaagtgctaacgtttatggacagacattgcaagtgaaacgctattataatcattttaatggcagtacctattattctttatatgataatcgaggtacttggcaaggatatattaatagtggtggaatgaagatggcggataatgcagctgggagtgcacaaagctatcataagaaaataaagttcacacaaaattttcctttgtggcaaaactttaactggaaaaagaaaagtaccgttacagatgcaatgaaacaagagacgtatgaagcaagatatgtatatcgtcattttaacggaagcaattacttatcaatttatgacaacaaaggtatttggcaaggttatattaatgaatcggccactcgccaagtaaactaaaaaattcaggacttgcgtatagattacgcaggtcctgaattttttttggtctcaagaggaagtgtgatcgtaaatgttgagccagcccctgggaagctgtcaactgtgatagtgccacctaacagtttcgtataatctttaacgatggctagtcctaagccggttcctcctgaattacgcgtacgagctttatctacgcgataaaaacgttcaaagatccgaacttgatcttctcgatctataccgatcccttggtcacgaactgaaagctgtaattgttttgctcgatacgaatagtcaacttggatggtcccttgtgatttggaataattgactgcattttcaatcaaattttttaagattggttgcagtagctctctttttgagatgaaaatcaactcttcgggaccattgatgataaaggacaactgtttttctcgtgcaattggttcataggagcggatgatttgctcaatcaatgctcgaaggttgatttcttgtgcggtgtaatcaaatgaatgactatctttggataaaagaataatctcttgaatcaaattttctagacgataggcatctttttggatgattttaaggaacgaaaccaatgtttctcgatcttctaaggcaccatccaataatgtttccgtaaaaccaatcaaagaagtgactggcgttttcaattcatgagaaacattaccgacgaaatctttttgcattttttctaattgacgcacccgagtcagatcataagagatccctaacaactcattttcattaaagagacgcaatgttacatcaagaactcgcggatgatcatcactcaaagcaatttcttcttgtaaagaaggggtctgctcgttcatgtgataaattaattgaatcaactgtgtatcatgaatcacttcagtgaatggttgtggcaattgaggcaatgcttcgatccctagctgctcttgcatggtagggttcagcaataacaatcggtcatcctgatcaatgataaaaaccccgatcatcagttcattcaacaggccatacaattgttgctcagaagcggcataagcttgataggttcgactcatttgttcactcaattgattgattgtctggtataagtcatcatgctcaggtgtttcttgcataatgatcgcctgttgatcaggagaagaaatcattttttttagaacaggcaaaatagtctgcacaggacgatttctttgacgtaacgcatgaaacgtcaaaaagctgacaaataaacaaaataggagataaacgaaaaagatcgaacgctgaatggtttggcttttagcaaaaaaaggtgccgttggttcagcgatccgcaaaatttgctgcaagttgccatcttctttgacagggatcgcaacatacagcaattcttcattcaatgtatcactttttcgcaaagactggcccagattactaccttttaagactgcttgcacttcaggccggttggctctgctttcttttaaagacgaatcgtaagtatcgtagatgatccgcccatccttgtccaataaagtgatccggctggaactatcctgtacataggcatcagcaaattgttgcaatgtcgctggttgattatcagaaaggttcaagaaaatcgccgctttttcttccaagaagtctacttgttgggcaatcacttgctggcgatagaagctgctaagaaattgccagcagatgataaacagtacggctaatagcagactccataggccatagccaaagcgtttcatgaatgaggctcctgaaatttataaccaaatccgcgaactgtcactaaatactcgggatgtttcgggtcacgttccagcttttcgcgtaaatgactgatatgcacatcaacgattcggctttggccatcaaagtcaaaattccaaatgcgattcagcagcgtatcgcggtcgatcacacggcctttccgtttcatgaagtatattagcagttcaaactcttttggagtcagaaaaatcttttctcccttgacgcttacttggtaattggtcaagtctgctaaaatgtcaccaatttgcaacatttctgctggctgatccgaaagatctgcagtgcctcgcggttccaaccgtctaaagattgctttcatccgagcaagcacttctctagggctaaagggcttggtcaaataatcatctgctccgatttcaagcccaagaatccgatcaatcggatcatctttagcggttaaaactaaaataggggtctcgattttttcttgtcgtagtttcttggtgatttcgataccgtccatttgcggcaacatcacatctaagataatgaagtcaaaatcttcagatagtgccagatcaacccccattttaccgtcgacagccgaaacgacttggtatccttctttttctaaattgaatgtaagtaaagtaacgatagatggttcatcatctaccacgagaatttttttcatcatgaactcctttcttaacaaaggaacaatcattttacgttgttctagctatattttagcatgaataaagaattggtactattgtctaccacaaataaatgctataataaaggacgatttgagaagaaagctgagggtgttcgatgattggaatcagtgcatgtttaggtggggtcatgtgccgctatgacgggcagcatcaagcggttgctcaactggttgaactcgttcaaactggtcaagcagtgatggtctgtccagaagtccttggcgggttgccaattcctcgtgagccagcagaaattgttggtggggacggtagagatgtttggtcacaaaaagccaaagtcattactgtcactggagaagatgtctcagaacaatttatgaacggcgcaaagcttgcctatcaaaaattacacgatcttgggatcacgcaactgatcttaaaagaaaaaagtccttcttgcggcagtcggattgtttacgacggcaatttttcaggagtcaaaaaagaaggtgttggtgtcgccagtgcttattttcaacaacaaggaatgaccgtgctgtcggatgtcgactggcttgctgagcaggaggaaaataatggagattgaaaaaaccaatcgaatgaacgcgttgtttgaattttattctacactgttaactgagaagcagatgaattatatggaattgtattatgcagatgacttctcattaggtgagattgcagaagaataccatgtaagtcggcaagcagtgtatgataatatcaaacgaacggaaaaaattcttgaagactatgaaaaaaaactacacatgttttcggattatatgatgcgggaagacttgttggagcaattatctgagtacaccaagacgcactatcccaaagatgaaacattgcgctcgttgatcgaagagatccaagaaatcgaagaataaaggaatgaaaaaagatggcatttgaaagtttaacagaacgcctacagcaggcgatgagcaaactgcgtaagaaagggaaagtttctgaagcagatgtaaaagaaatgatgcgggagattcgtttggctttattagaagccgacgttaatttacaagtagtcaaggaatttaccaaaaatgttcgtgaacgtgcagttggagcagaagtcttagacagcttatctcccgcgcaacaaatcgtcaagatcgttgatgaggaactgaccaaaacattaggttctgaaacagttggtattgagaaatcaccaaaaatcccgactgttattatgatggctggtctgcaaggggccggtaaaacgacatttgctgggaaattagccaaccatttgatcaagacagaaaatgcgcggcctttgatgatcgcaggggacgtgtaccgtccagcagcgatcgatcagctgaaagttttaggccaacaattagatgtaccagtttttgatatgggaaccgatgtcagtcctgttgagatcgttcgtcaagggatggcattggcaagagaaaagaaaaatgattatgtcctaatcgatactgccggtcgtttacacatcgatgaaacattgatggatgaattgaagcagatcaaagagttagcacagccgaatgaaatcctcttagtcgttgatgcgatgactggacaagatgccgtgaatgtcgccgacagcttcaatcaacaattaggtattactggggtcgttattacgaaactagacggggatactcgtgggggtgctgcgctttccattcgacaagtgactggtgcgccaatcaaatttaccggtactggggaaaaactgacagacttagaagtctttcaccctgatcggatgtccagccgtattttaggtatgggagacatgttgacgctgatcgaaaaagcccaacaagattacgacgagaaaaaagcagaagaattagcgcaaaaaatgaaagaaaattccttcgacttcaatgactttgttgagcagatcgaccaagtgatgggcatgggacctatcgaagatcttttgaagatgattccaggaatgagtcaaatgccaggtatcgaaaacgtcaaagtcgatccgaaacaaatcgcgcgtcaaaaagcgatggtctattcaatgacgcctgcagaacgggagaatcctgatttgctgaatccaagtcgtcgtcgtcggatcgcagcggggtctggaaatagcgtggtcgaagtcaatcggatgatcaaacaattcaaagaatcccgaaaaatgatgcaacaaatgaccaaagggaatatgaatatcccgggtatggatcaaatgtttggcggcggtgttaaaggaaaattaggtaaaatggccatgaaccgaatggtcaaaaaacaaaagaagaaaaagaaaaaacgtaaataattaactgaaataagcaagcagccgttatgctgatcaccatgaaaagtatcgaaaagattccaggatcatttctgatactagaagatggtttggtcgacaacggttgcttttttcgtttgcggtcttctgttcgtcagttgcttgtttggaaagggaatacctatcagttggatcgatagctgaaacgtaatatagcgacctttgaacatgtatcggctgagcaaggatagatggtttaactagctgatccaagtagattcattaagtacttgaacgcgttgcaaggcaaaatattcgtgctttagacggatagatgctactatttatttatagtaattgaaaggagcaagtgacgatgacaaacaaagatcgagttgaaggtaaaattactgaaacaaaagggaaagttacgggcgatgactccgaaaaattaaaagggaaaacccaaaacgaatacggtaaagtgaaagataaagtagaagactttgcagatgacgtttctcgcaaagtgaatcatttctttgataaacatgacgataaagataagcctaaccgctaatttaactgaaacaaccgttaacgatttcgttaacggttgtttttttcttttaaaaaggaagactgtcaaagaagtgctagctgacagtccggctattcataaagcgacgagcatgccaccattttttgattgctttcggataaaccaataggaagctgactacaagacagaccactaagtaaatacaaatcgaaacgatagttctcgtttgagagaagtcatcataatagagttggaccagcaaccaattcatattgatcaagtagaaccaagtaccaatggccatcactaaaaagacgggcaatcgaaaggcgggaaccgtcagatagtcgccgtcattttctaaggagatgcgggcaaacacttcttgagcagcagcaatcaacaacaaggataggagtagtgtggcgaagactgcccaccaattgactggtaagccattgggccagtcattccaaagattgttcaatactaagtgccccccttttccatagaagaaaaagctgagaaattcttgcagattatagtaaaaactgtaaaaaccgctcatcaagaaaaaaatcaaaacgatcgttaatggaccgaaaaagagattgcccaaaagcacccctaagaaggatccgatggctgtcactgccaaatttcctacaaacgtaccaacaccagatgcgaatagatctgatagcggaatttggaaatattcggagggaatcatcaagtagcgaatgcaaatattgctcaaaataccaatgattaaagcgaaactgaccggtgcaaataagaaaaccgctttttgacggaaaatctgtcgttttttaaacggcaatgagaataaaaaacgattgaaatttgtcttttgatcaatgaaaaaactaagaaaaccaaaaacaaacaataatggaagaataaaataagcgcctgaggtattgaaattagcaatatacgtatcctgtccattactttctggtaccggactattataaatgagcaagttttcatccttgtattcatcgatcgatgagtaatagactggtttttctccgttatagtccttaatatagtaatcaggatgctcttggaaatctttcttgaattcttctgaatcaaaatagttcttttgattgtgccaagaacgttgggtatcccagcccattcctgcataaatcaaaaccaagatcagacaaaagccaagcaacagtttgccatatcgctggcaataaatttgttttaacattttctttcacctctaacctttcaacagggattcttgactcaaattggcttcaaataaatcttccaaggtcaatgggagttcttcaaagagcaacggctctagttgccggatctgttcttctaatgccgcgtcgtattcttcgaacaaagcaacaatcacccgcccttgacgattgatcaatttcgaatgctgtttgatcattggcggtacctgtttcccacgaaagacgaattgaattttacgggcattttcccgcatcgtttctaaccgataatctttagcgattgttcttcctttgattaaaagggctcggtcgataatgttctcaagctcatttagattatgagaagcgatgatggctgtgcgattagattcactcaagttttctaacaaaaggccaatgacctttttgcgtacaataatatctaaaccgtcaaaaggttcgtccaatagcaagtaatcggcatttgaagcaatggctaagatcattttatacaatccttgcatgcctttagacattcggcgatacgaatggccaagcggcaatccattgctctgcatcagctcaagataaaggttttgattaaagtgggaataagcgagacgataaaaggcattgatttttttcaatgaatacgccgctaaaaagttctctttttcatcgatataaaataagttttcctttagttgtggcttctgggccaatgattgaccatcaatcatgatttcgccgccgtctaaagcgtactgtcctgagagtgtacggaaaagcgtggtttttccagagccgttgcgcccaatcaagccaacgatttcatttttgcgcaatgaaaatgtaacatcttctagaatagtagtcccttcaattttctttgtaacgccttctaggttcatttattgatccctcccagttcttcttcaaaaacagtgacccaagcagtgatttcttggatgctgatctgcaaatgtcctgcctcgatcactaattctttcaatcgttcttttaattgttggatgcgccgctcgtcgcgtggaacactgtccagtgctttgacaaacgttcctttgcctttgatggtgatcaagacctgctcattttctaatattttgtaggccttgctgacggtatttggattcatcaacaagcgtttggccatctcacgaaccgaaggaatttgatcacccggtctcaaaacaccatgcaagatgtcttctttgatgctcaatatcagctgctcgtaataaggtttgctgcttgtcttgttgatcatgaccatgtactcagcccctttcatttatgtgtactagtatacgtagtacactatcaaaagtaaagaacttttgctaaaataagacaaaaaggaggagtgactatgactcgttgtggttgggcaacaagtagtcccgcaatgcaagagtaccatgatcatgtctgggggaaaccggagtatgatgatcagcagttgtttcgtaagttggttttagatatgaatcaagcagggctgagttggcaaacgattttgaacaagatgtcaaattttgatcaagcatatgatcactttgatattgagacagtagccaattattcggaggaaaaaattctagcactgatggatgatcccggtattattcgtaatcgcagaaaaatagaagcggcagttcataatgcacaactcgtattagcgattcagcaagaaatcggaagtttttctgattttttatggcgttatgtcgaccatcgacccgtcatcaatcattttcaaacacaatcagaagtacccatccattcaccaatttctgatcgcttggcgaaagatttgaaagcccgtggctttaagtttgtaggaacgacgacaatctatgcattcatggaagctgtaggaatggttaacgatcacctgacaagctgtatctgttacgaggaacgttagaaagaagagaaaaatcgaggaggagtcttatatgggaaaactggttttttatggcgctatcagtttagatggctatttagctggagcaaaggatcaattggactggttgttggagaccgatacggggataagtactacgtatgagaaattttttgaaacgattgatgcaacagcgatgggccgtaagacgtacgaagaagccaaaaaaatgttggcgacggagaagctctatccagaaaaagaaaattatgtgttttcccgtcagatgcagaccgatttaacggacgcagtagttgtggatcaagacccggttgcttttttatcacaattgaaaaaagagaaaacggtttggttggttggcggtggaaagttattgcaccctttattggaagcagatctgattgatgaatggtatgtacagatcgctcctgtgttattaggaacaggcaagcgcttgtttgagccaggagagtatactactcgtttacaattcgtggatatgacgcaaatgggtgaactcgtagagatccactatcaacggaaatagatggcttgctttctgagtttctctttttctgtgttgcagatacttccttatgattcactcagagtttacattgaaccatccagcaaaaaaacgcacactcactggtttcccttatgggatagatcagtgagtgtgcgtttcttatctgactgtcacaaaatcgtgaccggtttttagttgtaacggttaaacaagtcgatgtagttgtcaacgattgtttggaagaagttgacggtatcttctttgatcgtattgttttcatcgatcaagttcatgattccaccgatataagcttctggttgttgcaaagtcggcatatctaagaataccaatgattgacgcaggtgatggttcgcaccaaaaccagcgatcgcacctggtgaaacacttacgactaaagcaggtttcccgctccagctgcttgctccataaggacgtgaaccgacatccaaggcatttttcaatgctgctggtacagaacgattgtactctggtgtaaagaagaatacaccgtccacactttgcaattcattacggaatgttgtccattcagtaggcactttgccttctacttccaagtcttcattataaaatgggagattgccgatttctaaaaagacagcttcgaaaccttctggcaataattctgcaaatttcttcgctaccagcttgttataagagccttcgcgtaaactaccaacgataaaaccaattttttttgtcatgttgaattcctcctcatatcttttacatgttttatcttaccaaaagtaagtaaaactgacaaataaaaagcatttgcctagaaaatccattcataaagcgatgtctcagctataatgactgtctctctctaatgatacgcgttgcaggaaaatctggcaaaagataacctatagaagaaagaaacagaaaaaaagagactgtaaagaaaaaactctttacaccgtcagtaaaacctgttaaactagctcttgtgattaaaacaatggaggtgtaaataatggcagtaaaaattcgtttaaaacgcatgggttctaaaaagaaacctttttaccgtattgtcgtagcagattcacgttctcctcgtgacggacgtttcatcgaaacagtaggtacttacaatcctttgcaagacccagctgaagtgacaatcaaagaagatttgattcttgattggttatcaaaaggtgcgcaaccttctgatacagtacgcaatattctttcaaaagaaggcgtaatgaaaaaacaccacgaagctaaattcactaagaaataaggtgacgacggatgaatgatttgcaagaattagtcttaacgatcgtttcaccattagtgaccaaacctgaggagatccagcttgatgtggttgaatcagaagatttctttgaatataatcttacagttgctccggaagatatcggacgaatcattggtaaacaaggtcgggtggctaaagcaatccggacgatcgtttacggggttcgcaccaacggccccaaaaaggtccgtttaaatatcattgatggaaagtaattgatcgcgtcactcattgagtgatgctttttttctatcctgttagttcatgctcaagacctatgacagatcggctgatttttgagataataagaaaaaggaggcgggagtatgtcacaagtgattgcatggatcctatttatttttgttttgatctttatttataaagtggggtcatttatctggcgcatattaggcgtattgtttttgctatttttactatggatctatcgggatgtcatctttacacaagttagtcaatggacacgagatttccgctgggatcaactaccaacttatttggaccaaggaattcaatgggtaaaagacggctggcaagccttgcaaagctggatttcgaataggattagctaggaacaggagacaagcaaagttgtttgtctttttattttggaaaaggtatgctctataaaaagggggaaatcatcatgaaaaaagaaataggtctcctagtgacagtattggccattggggcattagcaggatgcgacacgaaaaataatacggataagtctgagtcaacccgttcaagcactcatactagtacaaccatttcttctgaaagcagtagcagtagtagtgaggcagcctccagcagtgccgcgcaaacttcaagtaagacagttaccaaagcaggaacactggatcagttgtcagctgcttttccgcaggatcgcttgccatcagaggtgccggtgacggagcaaaagaccttgaatgctgcaaccgacgaaggggcagatcaactctctatcctctattatcagttaaatgatcaacgagaattgaatgatccatcattgaacaatgagacaccaatcgctagctacaaaaatgctgcttacgaaaatgaagaccaagcggcggaggctgtacatgcgaaccttgatgaaggcggacaggcggtcgatctaggacataacatcactggtcatatgcaaggtgcagctggttccagttatctaagttggcaagaaggcaattggaacttgacggttcgagcagtcaatcaagagaatcaagatcccgtgccagtagcaaaaaaaatcgtggcctatttagaagaagctatgctgcccgctccaggaattggtcaaatcaccattgatatgggaaaatcagattacacggctaacagcgtttcttggcaagacagtaagatcacttataccttgcaacatcaagatcctttatccgcattgaaaatggctgtctcaatgaatcaataaaagagccaatctaacgtgtaggaggaagtcatgcagattacgtatttatctgatcctcaagaaaagaaacagatcgcacaaaccattctggctgatttgccggaatggttcggcctgcctgaaagcactgccgattatattgaaaaaagtgcctatcaagaaatgatcgttgtagagaacaaaggttttttgacccttgtaaaaacaagtccagcgactgctgagatctatgttatgggcgtattgaaagccgatcaccatcaaggaatcggcagccaattgatccaagaagccatccgttggtgccaacgagaaagtatggcctttttacaggttaagacattggcagagacgcatccagaccaacactatcaacgtacacgaagtttttatgaggcgatgggttttttttgcctgtcgaaacatttcccaccctttggggagcggaaaatccatgcttgttgatgatccaagcagttccacctcgggaaaacactagaattccttaactccccatgctaaaatgagaaggattataaaggaaatgaggaccaatcgtgactgaatttttaaatgtaggaaaaattgtcaatacccacggaatccggggagaagtacgagtgatctcgcaaaccgatttcccagaagaacgctaccgtaaagggcaacgattaacactgtttcgagaaaataaagcaccgctggaattaaccgtcgctggtcatcgtaaacacaagaattttgatttattgacattcgaggggtaccccacgatcaatgatgtggaacctttgcgagacggtatcttaaaagtttcaaaagacgaattaagcgaactaacagaaaatgagtattactatcatgaaatcatcggcttgaccgtcattgatgagcaagccagagaactaggaaaaatcaaagaaatcctatctcccggtgccaatgatgtttgggtagtccaacgcaaaggcaaaaaagatgcgttgattccctacatcgaatcagtggtaaagcaaattgatttggataaaggcgaagtgcatattgagatcccagaagggttgttggatgatgaggattgatgttttaaccttattcccaagaatgtttgacggcccaatgggggaatcgatcattggaaaagctcgggaaaaagagcttctagaaatcaatgtctcaaactttcgcgaattttcggacaacaaacaccaaacagtagatgactacccttatggcggaggggcagggatgctgctgaaagttcagccgatctatgataatttaaaagcgatcgaaactgccaccccgcaaaccaaaaaacgtattatcttgttagaccctgccggtaagaaattcgatcaaaaaatggccgaatctttttcgcaagaagagcatctggtatttatctgcggacattatgaagggtatgatgaacgaattcgttcgctagtgacggatgaagtttctctcggggattatgttttgactggtggcgaattaggcgcgatggtgatgatcgatgcgaccgttcgtttgctgcctgaagtgctaggaaacgagacgtctgcgcagactgattcccactccacagggttgcttgaacacccgcagtacacgcgaccagcagaatttcaagggatgacggtcccaccagtcttgatgaacggcaaccacaaactgatcgaagaatggcgcttaaaagaatccttgagacgaacttatcatcgacgacctgatatgttggcggattatcccctaacagcagaaatgaaaaaaatgctacaagagatcgacgaagaagcttcggcagaggatgaatcaaagtaagaaatctcagtatctagaatcgcacctgcaatcaaatgaaaccaccacaacggatactagaagcaccagtctagtccgttgtcttttttatagagacaaaataaatgtcgggaaaaaaagctggtgacaagaaatttgtctttacatgagctggaaagttatggtaagatatttcagtgagtgtaaactcaactattacgatattccgctggagcaaattgctttaagaatgtttgggaataaggagaatgataaagatgaatccattgattcaagaattaactcaagaacaattacgtactgacatcccagctttccgtcctggggacactgttcgcgttcatgcgaaagttgttgaaggaacgcgcgaacgtatccagttatttgaaggtgttgttatcaaacgccgcggagctggtattagcgaaacttataccgttcgtaaagtatcaaatggtgtaggtgttgaacgtaccttcccattgcacacaccacgtgttgcacaaatcgaagttgttcgttacggtaaagtacgtcgtgcaaaattgtactacttgcgtgcattacacggaaaagcagctcgtatcaaagaaattcgtcgttaatcatttattatcagatgaagcaaaagcccttgttttcaagggcttttttcttttggtcaggaggggtctatcatttgctttaatgcctcatgcgcaagtaaataaggctgatcatgtagctgcatattttttaacagtatcccgaaaattgtcttttgttctgactgaggattcgattgaatccgaagaaaagtttgattagaatctcgaaaaagtcatgaaagtcgataaaaattatgctatacctaaacaaagataaaaattgaaatgagggatgaggatgaaagtcacttatttgggtactgctgcggcagaacgtgttccagccatattttgtaattgtaggatctgccgtcatgcgatggagaaaaaaggccgggagattcggacccaaacgcaagcgttgttggatgatggcaagcttttgatcgattttcctggggacagttacctgcaccgattgagtggtcgagtggattataatcgcgtcgaagcattattgctgacccactggcactcagatcatttttacggagaagatttagcttatcgaatgtccggctatgccaatgggatcacgactcaattggctgtctatagcaatgcctatgtgaaaggtttttatgaccgagcgttccaattggaaggacgttacgatgaacaacgcctgacgtatcatcttttggaagcgtatcaaaaaacatggatcaatggctatgaagtgtattctttaccggcacaacatggtcattttgccgaagattgttttatctatgtcatcaaagatccaacaggcaaaacacttctctatggacacgatacaggctacttgacggaagagatgtttgcttttttagaagcaaataagtttatttttgattgtgtatcaatggattgcacggggcagaccaatgctgaccagatggccaatcatatgaattggtcgcaaaatattcaaatgaaacaggagctgatggatcgcaagttagcgactgaaaagacgatctttgtcgccaatcatttctctcacaatggagggagaacctatcaagagatggcagatctctcagcttcagaaatgatcattaccgcatatgacgggttggagatccatctttaatccgtctgacgattaattcatgaatactgaatgtcaacaactcataagggaggcaaacaataaaaatagatcatgaaaatagcgtgttaagtgggaaacgatgtccagcgagatttaggtgctagagaaatgagtaaataaagaggaatgatttttcatgagaaatcagaaatttgaatactatatgcgagaattaaacctgattaaaagacaaaactggattgaaaatgacctatatcatctagttgcggaaatgattaaggctggcaaaaatatgtctaggctatctttaagagatgtaagcttgcgaagtaggagtccaaaaggtcagatattctatggcttatcttcatttcctgattttgtcatcttggatgaacggtttgataattcagataatcttgccgggggaagtgtaaatatagcgaataaaaatttgatttatggctgcgttgaagtaaaaaatgtcgatgagaagctattagatctagaatcaatcgatctaatatcagaatttgagaaagcaaaaaaaccaggaaatgaactgaatcaagatttaggccaactcttaggacaaatactatggtttaaaaaagttttgtatacaaatggcaatatatggaaattctacaaacgaacaagtcaagaaacagataactttcttactgacaaatgtatagaaaagttatttgaggatcgtatgaaaaatgaggcccctgattacaaatggtatgtaggactagatgacgataatttaaagattgaaaaagtttttgagtttgtcttagagagtgatataaaaaaagaagtatgggaagaatttctaaatagcttatattcgattaactgggaaggataaagatgctattgtggaagaataatcatcttttagaaatgaatcaggttgttttacttgcggctcaatggattgcagggggcagaaacatgctgattcaatggccaatcatatcacaatagccgaatgaagcaagaatggatggatctcaagggattgactgaaaaagggatctctgttgccaattacttctcacaatgggtgaacttatcagcaaataacggatctctcagcttcagaaatgattattaccgcatatgacagggttggagagctatctttgagccacttggaaatcgtctagcacgtataacgctatcgtcagtttaataagcgagttgaggacctatatttgatctcctcgattcgctttttttgatagtctgagataaaccgcttgctgatgaaggagtgtagctaataaaaaaaagataccagttgaagtgcgaaaaagaaaaaaatagaagttgttcttgaatgaaaatagttggaaaatcatttttcattttcttttatgcctgttaaagtcaatgataccaatcatattaacaagaccaaaaatgaaaatacaaaaaaaactgttcttagtattgactcataaaaaataccactactatacttgtattgtggttataaccagttaggagagacatcgatgcaaaatacatttcaatcaaaatcactttattatcagctggtagaaatattgaaacaacgaatcgaaaacagtatggtcgctcatgataagctgccatcagaaagagagttgaccagtttttatggcgttagtcgcacgacggtgcgactagcattgcaagaactggaaaaaatgggctacatttatcgacaacatggaaaaggaacctttgtttcggaattaaggacaaatgcgactgatctagctggcgcatatagttttaccgaacaaatgcgggcaatgggcaaacatcctgaaaccaagatattggccttcaaaaagattgaagcaaccaagtatttagcggggcatatgaatgttcaattaggtgaacctttgtttcagttagaccgtttgcgcttagccgacgatctgccaatgatgatcgagaaatcctatttgccagtgaagctatttatgacactatctcgggaactgctatcgataaaaccgttatacgatttgttttctgaagatttcaatcaaacggtacgatcggctgacgaagaattttatgccagtattgcccagaaagaagatagtgagctgctaaatattccagaaggatcaccagtgctccatttagttcgctcaacctataatctcgagaacgaagtgattgaatttacattaagtgtggcacgggccgataagtttcattataagatcaggcatctgcgttccactaactgaattggaggaaagaaaatgtttatgttgtcaaaagaagaactgcaaaagctaggagcagaaaatactacccgagaaattcgacaacaaccggaactgtggcatgagacgtttgaccgttatcaagaaacagtcgcagatctagatcgtttgtttacggatgcgaaacaacatgctggagagcgaccgatccgcgtcatttttacaggggccggaacctctcaatatgtgggggatacactaattccgtttcttactagtcaaggaaatacgaatcagttcatttttcaaagtattggttcgaccgatatcgttgctacgccaaaagaatacctgattcctgatgagacaacgatcttggtctcatttgcccgcagtggaaatagtccagaaagtctagccgcagttaagatggccaatcagctggtcaacaagatctatcatatcgtgatcacctgtgcaccagacggattattggctacacaaatgcctacaaaaaaagaaaatctagttttactaatgccaaacaaagccaatgacgctggttttgctatgacaagcagtttcagctgtatgacgctgactgcgctacttatttttgatcaagcaagcaatcagcaaaaagaaagatatgttcatcaattaagccgactaggagaagaagtcatccaacgagaatcagagatccaagggtatctggcatcagactttcatcgcatcatttacttaggttcgggaagcttaggcggattgactagagaagcgcaattgaaagttctcgagttgactgctggaaaaatcgcaaccgtttttgatacatctttaggattcagacatggtcccaaatcttttgtcaatgatcaaacattggttttcctgtttgtcagcaatgactcatatacgcagaaatacgatgtagatatgctggacgaaatcaaaaatgacggtattgcccaacgcgttgttggaattggtcaaaagggttcattgtttagtggtgattcctttgaattagctgcagattcgttactgccggatggctatcttgctttagcagatatcatggtagcccaaacgatcgcattactttgttcggtgaaggttggtaatacaccagatacaccatcgccaagtggaacagtcaatcgtgtggtcaaaggtgtaacgatttatccatatgaaaattaggaaagagtgtgaagcatgttagaatggtccgaaaataaaagacaagcaatggaacgtttatcgacgccggagggcattattaccgccctggcgattgatcagcgtggtgcactgaagaaaatgatgtcagctttagggatggaagcgacgaaagaaacgattgagcggtttaaaaccctgatttcacaagaattgacgacctatgcctcagccattttattggatccagaatatgggttgcctgctgcacaaaaacgtgcagcagagagcggtcttttgctagcatatgagaaaaccggttacgatcaaaccgttcctggtcgctttcctgatttgcttccggattgttcagttattcggtttaaagaatcaggtgctgatgcggtgaaatttttgctgtattacgattgcgatgaagaagaggaaatcaattttcacaagcaagtttttgttgaacgaattggaagcgaatgcatggctgaaggactgccattttatttagagttattgtcatatgatgctaaaaatgtagacacgaaatcgctttcctatgccaaagcaaagccgcgcaaagtgatcgaaatgatgaaagaattctcgaaaacccagtataaagtagatgtcttaaaggttgaagtaccagtaaacatgtcatttgttgaaggggatgcaacaggggagatcgcctatacacgtcaagaagctgccgcttattttaaagaacaaagcgacgcaacagatttgccatatatcttcttaagtgctggggtctcagcggcattattcatggaaacattgcgttttgccaaagatgctggggcacgattcaacggtgtactctgtggcagagcaacttggaaagatgcagtcgctccttttgttgaaaaaggagaagcggcaactttagaatggctgacagaacaagggacacaaaacattcgtcaattgaatgaagtgataagagaaactgccgtttcgtggcatgagaaagtagtacagccagtccaatagagcaattcaccttgcaaagctgactactaatgaatgggagcagaacatggctacgtttgaaataaaagaagagtttttaatgaatggttctccttttaaactactatctggtgcgattcattattttcgggtccatccggatgattgggagcactctctttataatttgaaagcgcttggatttaataccgtcgaaacctatgtgccttggaatttgcacgaaccgcataaagggttatttcagtttgaaggcattcttgatttagagcgttttttgtccttggcacaagagcttggtctgtatgtcatcctgcgaccttctccatatatatgcgccgaatgggaattcggcgggttacctgcttggctactaaaggagtctggacgattaagagcatgtgatccgagctatttagcgcatgtggcggaatactacgatgtattacttccaaaaatcattccctaccagttgagtcatggagggaacattctaatgatccaagtggaaaacgaatatgggtcatatggtgaagaaaaagcttatttgagagctatcaaagaaatgctgataaaccgtggcattgatatgcctttatttacttcggatggtccttggcaagccgccttacgagctggcagcttgattgaagatgatgtattggtcacagggaattttggttcccgggcaaaagaaaactttgcagcgatgcaggatttttttgatcagcacaacaaaaaatggcctttgatgtgtatggaattctgggatggctggttcaatcgctggaatgaaccaattattcggagagacccagatgatctcgctgaatcagtcaaagaagctttggaaatcggtagtgtcaatttatatatgtttcacgggggaactaattttggatttatgaatggttgttcggctagaggcgcagtcgatttaccgcaggtcacttcctatgactacgatgcaccattggatgagcaagggaatccgacagcaaagtattacgcattgcagaaaatgctaaaagaacattttccagaatatgaacagcacgaaccgcgcagcaaaacatctctatcaatggaacttcaactacaagataaagtcagtttgttttctgttatcgatcaaatcagtcagccggtcaagacggtttatccgcaaacgatggaacaattggaccatccttatggctatttgttgtaccgcacgaagaaacggcgggacgcggaaacagaaaagctccggatcattgatggaaatgatcgtgcccagattttcttgaatgaaacattccttgcaacgcaatatcaaggagaaattggtgaagacttattgattaagcaagcagcagaagaaaatcaattggatattctagtagaaaatatgggacgagtcaactatggacataagctgacagcagagacccagcgaaaagggattcgtagaggtgtgatggctgatctgcactttgtgaccaactggactcattactggctagacttcagtaagtcaccagcaattgattttacgcgggactggcatccagaacaacccgggttttatcgttattcctttgtgctagaggaaaaaagagatacttttattgatttgacaggattcggcaaaggagttgttctggtcaacaatgtcactgttggacgcttttgggaagtgggccccattttatcattgtacgtaccaagcggatttttgaatcatggggaaaacacaatcattatttttgaaacggagggctgctttgcaaaagaagtacatttgagaaaagaaccggtttataaaacgatggaggcgaaaaaagtatgagtattattggtgtacgtattgatggacgattgattcatggacaagtggcaaacttatggacgaccaagctgaatattagccgaattatggttgtggacgacgatgtagcagaaaatccaatcgaaaagagtggcttgaaattagcaacgcctgcaggggtcaagttaagtatcttgccgattgagaaagcagctgccaatattttggctggaagatatgattctcaacggttgttgattgttgctaaaaaacctgaccgtttgctcaaactagtggaattaggtgtgccgatcactgaaataaatgttggaaacatgtcccaaacagctgaaacaaagtctattaccaagtcaatcaatgttgttcccgcagatattgctgatttcaaagaacttgctagcaaaggtgtgaaactttttgcacaaatggtccctagcgataaagctgaaaactttatgagccttttagaaagataggagaatcaatatggaaattcattggtggcaaattttattattatcattatatgcaggttatcagattctagatgaattacagatctattcttcaatgagtgcgcccgtttttgctggtcttttttcagggttagtgatgggagatatcacaaccggtttattgattggtggtagtatgcaactgacagtccttggtgtaggaacttttggcggtgcttcgcggatcgacgccaattcgggaacggttttggccacggcattctctgttgcattaggaatggatccagaacaggcaattgctgcaattgctgtaccggtagctagtttgatgattcaattagatattttagctcgttttgcgaatacgtattttgctcatagaatcgatacccacgtggaaaatatgaatttcaaagccatcgaacgaaactttttgttgggcgcagcaccgtgggcgctatcacgacttgttcctgtatttctcgcgttggctttcggtggcggattagtcgaaaacgttgttagttatttgaatggtgatttaaagtggttaggcgatggattatccgttgccggagcagtcttaccagctgtaggttttgcaattttacttcgttatttaccagtaaaaaaacattttccttatcttattttaggctttgttttgacagcattattaacaacggtatttagcaatatccaactattgggcagcagtgtagcaagtgttgtaaaagatttcagcggtaccttcaacgcattaccaatgttggcaatcgcactaattggtttcgcatttgccgctatcagctacaaaaatggacaagcacgtccagcaactaataccgcacaaaacgagcagcattcggaaggagagattgaagacgatgaaatctaatgttaaattaacgaaaaaagacttccaacaaatcaatcggcgcagcctatttggtttccaactaggatggaactatgaacggatgcaaggctcaggttacttgtacaccattttgccgcaactacgtaaaatctatggggacaacacccctgaattaaaagaaatgatgaaaacgcatacacagttttttaatacatcaaatttcttcaataccattatcacggggattgatctagcgatcgaagaaaaagagggatttcaggcaaaagataccatttcagggttgaaagccgggttgatgggacctttcgcagcaatcggtgattcgattttcgcagccctagtgccaacgatttttggtgcattggctgcgaatatggccatcaatggaaatccgatcggcatctttatctggatcgctgcacaaatcgtagtcatgatctttcgttggaaacaactggaatttgcttataaagaaggtatttcccttgtgacaaccatgcaaagccgcttaacagcattaacagatgcagcgacattactgggtgtttttatggtaggagcattagtggcaacaatggtcaatgtaaaatttgcttgggcaccaagtattggtgaggtcacattgaatatgcaaaacaatattgatatgattttgccgcggctcttaccagcagctattgtcgggattgtctattggatgttaggaaagaaaaacatgacatcaaccaaagcaattttcgtcgtattgatcgtcagtgtggcactgtcggcgttaggagttatttcgaagtagatggaaagtaggtaggaagttgatggaaaagcaattagtcttgattagtcatggccggttttgtgaagaattgaaaaaaagtacagaaatgatcatggggcctcagtcagagatccagacagtcccattattaccagaagaaggtgccgatgattttcgccaaaaactagcagctgtcatcgctgacagtcaaaaccctgtggtctttgctgatctgctaggaggaaccccatgcaatgcggcttctcggttaatcatggaaggtgcgacatttgagctgtatgcaggaatgaatatgccgatggtgattggcttcctcaaccgtacattgacaggagatccattggattatgaacaatttggtaaagagaatatccaacatgtcaacacgcttctcactgcagtagcagattttgaagaagattaagcagaggcaaagacattagaagttgatcagcaaagaaaaaccggcattagctgtacttcttagctatcacctatttgccttaaccaaacgacaaaaagcgctgaaaagccccaactctttgaacaattccctaaaaaaaggtatgatagctaaaagtatatttttgaagggacatcaaagggatgaagtactcaacgaaatacagcgatgccattcatattctggcctatattgaaatgttgaagggaaccgatctatccagtgatcgaattgctcaaagtgtcgagaccaatccagcctatgtccgccgaatcatgagtgatttgcgaacagctggcttgattgagagccaacggggaaaagctgaacctaaattactaaaaaaacccgaagagatcactttgctagacatttattcaagtgttgaaaaggaccaacgattgttgcatattgacaaaaaaaccaatcctaattgtttgattggcggtagcattcaggaagttctagatgagacctatgagcgtctgcaaaaaaaaattgagttagagatgcaacagatcacactagcagatatcatagataaactcaatgtggctgctgaaaaatgaagagagacagctccgtttcaaaagcaaatgcttgacgaaaaggagctttctttttataatcaacatgtaaccttaaaagttacatgtatttttctacatgtacaagtttaaagatgaaaggaagagagcaatgaaaattggaattattggtgcaacaggaaatgctggttcagcgatttatcgggaagcaagtgcacgaggacatgaagtcgtagctatcgtacgcaatgaagaaaaagcaaaggaaatgtttgggaattctgtcaaaacaataaccaaagacgcgtttgaattgaaaagaggcgagttggaaggttttgatgctatcattgatgcgtttgctactagccctgatcaagcctatctacatgtcgacttagcagcccgtttgatccatcttttccgtggaaagaaaactagattgttcttcattttaggggcgggtagtttactgaatgatgctggcgacttgaatgttaatgacttgaaaaaagcacctgatagtgaaagctggatcgcgattccagaaaatcaattagacgagtacaatttcttattaactgttaaaaatgttgattgggtaggaatttctccagggaaccttttccaagctggggaagctaaaccggctattttaggaaaagatcacttgcttcaaaatgatgccggacaatctgtcacatctagcggaacattggcaaaagctattttggatgagttagaagtccctcaatatcaacaaacaagatttacagttattgatgcctgatttttttgacgatcgggatggtcttgaggagcaaaggagcggaaagaacagtaatgttttcataatgtttcttccaagaaaacaggaaagaaaccattttagaagaaagagttttcgaaattcaagaattctaccaagacaaaactctgcgagttgcttataatcaatagcagaggtgatggatatggagaaaaaagaagcatacgagctgatgctccttcagttaaaaggattgttagaagcggagagtaactggttagcgaatctggctaattcttccgcattgctgaatgaaacgttaccagatacggtctttgccggctattatctgtttcaagaaggcgaattgattctaggtcctttccaaggccgcgtgtcttgtacccgcatccagttaggaaaaggggtctgcggggagtccgctgctgagaaaaagactatgatcgtcgataatgtcaaagaacatgagaactacatatcttgtgactcggcagcaatgtcagaaatcgttgtgccaatgctggacaatgaccaactgatcggagtattagatatcgatagttcgaaaacaagtagttatgacgagatcgatcaacttttcttagaaaaatttgccgcttcgctagtagctgcacggcgtaattgataaaacgagcagcgaatcgtgttcgctggtacaaaagaaatacccaaacgatagaaagcgcaactttagttcttgaagttgctgaattgccggcttgtttctgaggcaacttctattcgtttggtttttttgtctgtactggttttttgtgcgaatcaatgcgtattacttttaattattaaaaaacgatgatattatgataacataattagaaaaattaaatttgaaggtggaaattatgaattgtgataacattgttttaggaaaagcgtatgaatgtaaaccggtaggtatgcaaaggaggatcatcggtgaggtaatccgcaaaatggaaaattgtgtggtgatgagtgtcgtaagatatgatggcattgatcatgacgaaatcgaggaacgatgtggaagagtcgttgctcggtataatgaaatctatggaccagctttagtcgaatgtttttttagttaaaaaaagacagaagcttattgtttaaaaacaggaaaataatgagctcaacaattaaaaataacaatttaatcaataatatttacggtgttagccaaattttttcagcaaagagtatcctttgctgtctgggacagtaactttcaagggcagaatacttgcctaatagttacggatcctattttctgctatcatcgttttttgtatgctgcgatagactgccaggcggccaataaatttcaataaagacttaatgatggtacaataaattaaaatcgtacgcctggaggagaatgttatgagagctgaattagtgatcttagaagaagaggagttactgtttaagcttcccaatgaacaaggtttattacaaattgcagatcatgatcgtgtgacacagcttgataatactgtgttttttcttgttaagaatcatgcggtaacagctattacaacggatacattgctggacttgactcagccccatgatcgaatcattagtattactcctagctgggaaatccaggcaccttaccttgcacattattatcaggagaagtatggtttgttgaagaaaaaaagtgaagcgatcccaggtgagcaaagtgagctcattgcatcttgcgcaaaaaattttgacttattgttagataaacttggctattaccaaaataccacttcccttgatccagtgaaaaaaacaaaagcaaggcatcaatggaaaaaagaattgcaggatcgacctttctatattgactatcaaggaagtcaggcaactgtttattggcaaaagcgcaatgaaatgcgaatcgaaaaaggggcaaaattagccgaagaaattccatataataaagacggttccttgggattttctgctcgcttaggagaaaaaatccgccaagatcatcaagcagcgattaaggatcattgcacgatagaagaagttattttaaaaagtgtcaatgaggttggtctgtttctttactacggagggaccaatggttggttgcagttaaaagacccatccgggcagacactccacgaactaaccgtggtgggctgacacgacaaatacgcgatacgcagtcgaaggacaacgcttgtcagatgaaatggattctcatcggcaagcgctgcccttcttttttagctgaactttcttgaaataagtttcaactcagttcttgctggaagatacaattgagtcgtcgaataaggaataatcttgtccactcttgtttattactacggaaggttttccgtttccttctttttctgcacgataagcttcacggtgtttttgcaagtgttcgggccgctttagccaggcttggaaatgtttcttttcttgccattttgagacgagttgaaaatcgactgatgcttttttttcgttgatccaacattcagattggagacagccttcaaacgttttcatcgaggcgatatctttgcggatcttttctgaaaatgtttcttttgcttctgctaaaacttcaaatgtcacagttttgatatacatgaccaacactcctttttgtggtaaatgcacgatttgactttgcatcatcattttccaattagtataactgtaattgagaatgattgtcaattaggtcggtatttttcttagaaaatacttgcttagtgaaaaaagatgtttctttcctacctaagaacagctaggaaagatctctccataggacctttctctaggtatcttagaagattctttcaagtaagggaatttgacagaaagattcgaatcacggtaaacttcacttaacaaaacggaatttttagaattatctgaaaaataggaggcgtcaagaatgacaaccaaagcaagagttatcggatcactcatcgtttgtagtttttttctagcagcctgtcaacagccgtcatcgaaaaccacagattcaaccaagtcagcaaatgccaatcagccaatgctgaatgttcagttttctgctgaaatggggagcgccgatttgtcgttagcaaccgattcttacagttttattaccttgaacaatgcctatgaaggactttatcgactcgatgaaaacaatgaacccgtgattgccggtgcgagtgaagacgcaatgatcagtgaagatgggatggtgtacacgatcaaattaagagaagatgccaaatggtccaatggggaacctgtcacagcagaggattatgtctttagctggcaacgaacggttgatcctgctaccgcctccaactatgcctacatgctagcaccagtcaaaaatgctgcagctatttccgatggaacgaaggataaaagtgaactagggatcgaagccgtcacgagtcatgaattgaagattacattggaaaaagcaacgccttattttaaatctttactcgcttttcctacttttttcccgcagagtgaagcggttgttcaagaacatggggatcaatatgccttaacaagtgcgaatgcagtctacaatggtcctttcacattggaggattatgacggcccaggtacagatattcaatggacactcaagaaaaatcctgagtattgggatgcagagtcagtgaagttatccggagttcagtttgatgtcgtcaaagaatcttcaactagctataatttgtatgaaagcgggcaagcagatgacatcacattgagtggggaactggcgatgcaaaatgtaaatcacaaggattatgttgttcaaccgagcgcgacgacccagtatttagaaatgaatcaagcagcggaggactcaccgtttcggaatgaaaagttgcggcaagcaatttcctatagccttaatcgtcagcaaatcgttgatcagattttaggtaatgggtcacttccagctgttggatttgttccttctgatctagcctttaatcctgaaacgaaaacagattttgttaaagatgcagggacttcgctgccttatgatgaagaacaagccaagaaattgtgggagcaagcaaaatccgaactaggaaaagataccctcacctttgaattactcacctcagataccgatcaatcaaagaaattagccgaatacattcaaggaacgcttcaacaaacccttgaaggattgactgtagaagtgaccaatgttcctttttctgtgcgattagatcgttccaatagcggagatttcgaaatggtcatgaacaattggatcggtgattatgcagatccgatcaatttcttggaacttttcaaaaaagatagttcatacaatcgcggaaaatggttggatgatacctatgataacttgatttcagaagcatccgatgcatatgccaacgatcctcaagcacgttggcaaaatatggtggaagctgagcagattttgaatgaaaaattgggcgtgattccattatttcaaagcgcagaggctcatttacgttccccaaaaatcaaaggcttagtggtccatagtgtcggtgcagcctatgactacaagaatgtttccctagagtaaagaaacaagcagtaagttagaagagatggatctttcatctttccccagattgcacaagcaaaaatgatcaataaatcagcaaaggagaacctagtgaaaaaagcagtccaagcagctatgacttttttatggaaacagccgcagcaaaatgcagttttaacaaaaatcaatgcgcaacctttagaagcagtccattcgtttttatcagcagcagatgcaatgactctctatgaagaggacttggttgattcagagattctttatgggaccgttgtcgaagtcgttcaagaaaaagaagaatgggcagaaatcattgtcttagaccaagcaagtaataaaaatccccgaggctacccagggtatgttcctagcaacgtattgactgtcatagacgagaaatatggattggggaaaaatcagaaggtagcagtaatcaaaccaactgctgtcctgcaattcaaagatcatcaaagaatcctttctttcggaaccctgctggattggctttttgaggacgctgagtggtatcatgtgatgacacctgaaggaccagctgaaatttctaaaacacaagcccaacgaatcgatcaaggaaactcaacaactccccgacaattgatcgagatggcagaacaatttctggatttgccttatgtatgggcagggatcagcagcagtggctttgactgctcagggtttatgtatagtttgcatcgggtcaatggtattttgattcctcgggataccattgaacaagcgcaagcgggtgtgcagcgatcctatgaacaggcgcagccaggtgatctattgttgttcgcatatgaagagggaaaaggaaaagtccatcacgtcggtctttatttaggtgcagacgagatgatccactcacagaccccaggctccaaagtcatgaaaacaaagatcactggttctgcttatgagccggaattggcagttgtcactcggtatatcgactagaaacagccgcaataagaaagaatgaggtagaaatcgcaagtgatagaaacaaaaaaatagcagtaaccgaggaaagcccaccatttttgcagaatgcagcaagaaatgtcgggctttttgaccgatcaaaagagagatcagttattagcgacaataaagtcacccatatcgtatcgatgccgggattgtgaaaattcaaaaggtatcccattttctaagtaaaccgtttgctcgacttctaaaatggggtcattgggggaacaaatcaaatgctgctggtcatagatatctggacggtcggctttgatccttcgaatcgatgtgccaatcggtaagtgcaatgtattggaaatatattcataaacggaagctttgagaacctcttcggtgatgccgggaatcactgcgactggcataatggtatattccagcgcgaccgggacgtcatccaataatcgcaaacgaacaatatcatagattcgatcttctttaccaagtctcaattttgtttgttcttgctcatcagccaaaagcgtatcaaaggaaatgattctgcttgtgagtttgccagtctttcctaagcgcttggttaatccgcggttcactcgggcgttataatcgaaggtagaataggcttcactgacaaaagtgccagtgccttttttggcatagatgattccctctacttgcaacaaattcaacgccttttgaatggttactcggctagttttatacgtaatggctaattcagtttgtttaggcagcttctgattcttctcatactttccatgactgatttgtgtacgaatatctgctgcaatatcatgatagtaagccaaatcatttcctccttttttgaagcataatcgattttgctgagtatgtaaacctcgacgtttacatactcagctttttgcttctttcgacgatttacagaatgaaaaaaatccagtaaattgagattgtaatcggttgcatttggtttgtttattttggttaatcatagaggagctaggaggagtaaaaatggaagggtttatggatcgattggcaaatggcttaggtaaagttgctacgagaatcaatagttggcggtacatcatggtaattaagaacgcttttgccgctttgataccagtcattatcacaggtgcctttgggaccttattttcagcaatggtttttgattcggagaacggcttagcaaaaattgatgcgctcagctttttagaaaatctaaagccgatctcttcggcagtcagttatgtaacacttagttttctaacgatttatgctgtttttttaattgggatcgaactggcaaaactgaacaaaatcgatggtgttttccctgggatcattgcagtgatgtcttacttatcggtcaatccgatggtttttgaattcttacatgaagatgctactgttattgccgagaatgttttagcgaaacaatatacagatacgaaaggtttattcttgggcatgttcgtggcaatcctatcaattgaactttatgcctggctttgccgccaaaaaagattgcaaatcaagatgccggaaagtgttcctgccaatgtctcagcaagtttctcggcgcttttccctacaatattagcagtaacgatcatcgcgacagttggctttgctatcaaagccatcacaggaatgtatgcttacgatatcatttataatattgtgcaaaaaccattagaagggatagtacaaggtctgcctggtatcttgttgttgatgtttattgcacaagttttctgggtcattggtatccacggcaatcagatggtcaaaccaattcgtgaaccattactgctagcggctatcgccgtgaatacagaagcctttgaggcaggaaaagaagtgcctaacatcattacgatgccattctgggatatgtatatgagtatgggaggatcaggtgtcaccattggcttgctgattgctatcttgattgcaggcaagcgtgaagatatgcgtcaaatcacgaagctgtccttagcaccaggcattttcaatatcaatgaacctgttattttcggtatgccgatcatgctgaacccgatcttggcgattccatttattctgaccccgattattaccggcacggtgggttatattgctacatccatcggttttgcagcaaaagcggttgtgatggtaccgtggccaatgccgccaatcgtcaatgcctacttagctacagcaggagacatcggtgcagtggtcacacaaatcatctgtattttattatcgatcattatttatttgccattcgttatcgtaatgaatcgttcaacgaacgaagtggcataaaaaggagaggcttatgttaattgaaataccagaaacatttatcttaggggccgcttcttctgcttggcagacagaaggctggcaaggaaaaaaagcgggtcaggattctttcttggatcaatggtatcaacaagagcgttttgtctggcatgaaggctatggaccagccgttgcaacgaacttcatggaacagtatggtgaagacattgagctgatgaaagagattcatctgacacattatcgcacatccatcaattgggcacgcttttttaccgactatgagaagttgatcgtcgatgaagaatatgcagcccatatcgatgcggtgatcaatgcattgcttgctgcaggagtagaacccatgttgtgtctggaacactatgaattgcctgcctacttattagacacgtatgatggctggagttctcggtatgttgtcgaattgtatagcaagtatgcagcaattgcctttgaacgttatggtgatcgggtcaagcactggttcactttcaatgaacctatcgtgatccagacccgttgctatcttgatgcgattcgctggccccatgaacaaaatacgaagaaatggatgcaatggaattatcataaaacattagcttctgcattagcgataaaaacatatcatgaaaaaggctatcaaggcagaatcggctgcgtattgaatcctgaaatggtgtatgctcgttcttcttcgaaagaagatcagcaagcgaaaaaaatgtacgatcttttcttcaaccgagtcttttttgatccgatgattaaaggcatttatcccgaagaactgattgcattatgtaaagagcatgatatttattttgatcctgcaaaagaagacttagaagtgatccaacaacatacggttgattttttaggaatcaatcaatactatccaaagcgtgtgcgggcaccttattatcagtggaatgctgaaacaccgtttcatccggagcgattctatgagaactttgatcttcccggcaaacaaatgaatcgttctagagggtgggaaatctatccgaaagtcatgtatgacatggcaaactacctcaaagaaaattacggcaacattccttggcttatcacagaaaatggcatgggtcgggagaatgaagaggcgttcatggatgagaatggtcaggtagtagatgactatcggatccaattcatttcccaacatctttattggcttttaaaagcagtagaagaaggggcgaattgcgaggggtatatgctctgggcttttaccgactgtatctcaccgatgaatgcctttaaaaaccgttatgggctggtgcggatcgaaagaaatgctgcccgtacccgttctttgaaaaaatcagcctattggtatcgagaattaattgatgaacgtcgcttgtcctatgaggaattaccgcttattctttaaactaagtacattaagattagagaagctgtgacaaatcttttgtcacagctccttgtgtatattgcttaaaaatccaattgatgaggggctaatttgtcccagtcaaaggtcacaccaattcccggttcttctggcgcgatagccattccatcctctggatcaatcatcagagggcgagtggtgtattgatcgatcgggaaactatgcatctctaggtatccggcattaggcatggcagccagcagactgacatgaagctcttgcatgccgtgagtcgagatactgacattatgcaactgtgtcaatgccgcaattttcagccagccagtgatccctccacaattcgaggcatccggttgaggaaaatcgacttgaccataagataacatatgagcaaattcaattggtgttcgtaaattttctccgccagcaactgctatttgaccttctttagcgattcgagcatatccttcgtagtcttcgggaatcgttggctcttccaaaaagagaatatcaaaaggcgccatcaatttagcggctttgacggcttgttcaacggaccagctcatattggcatccaccataaaggtaatatcgggaccgatcaatttacgaacggctttgatgcgggcgatatcttccgccaatgttgcttgccctaacttgattttgacagcccgtaatcccatatccaaatatttttgattgttggctaataatttttctaatggaaaattcaagtcaatggcaccgccatagcagtttactttattgctgtgtcctcccaaaagtttatataatggttctcgtgctttttttgcgcgcagatcccaaatggcaatatcacaggcggcaatggcaaagcttgctagaccacctcgggcaatgtaatggatgccccaattcatctgttcccaaagagcttccacacaagcaggatcttttcctagcaggatatgtttcagttctttgtcgatcaatttagcgatcgactctcctccgaaaccacccgtatacgtataaccgataccttctctaccatcatccgtgcgcactttgacgattggcacctcaaagtgagtgtgtaatccgtgtttggcatcttccattaattctggtaagggaatccgatagtaggaagtttggatttctgtgatcgtggacataaaattcctccttttccaataatgttaacgtgtgcattattatcttaacatccacttggcaagaattcaagcggtttcatttgtagtttgagttgtcaatctctttctatcattgtaataatcctgtttttccagcgacctttaaccaagtgattccgatctgaaaaggagtcaaatttcttggtgggaacacgctgaaatagttgaacttctgcgcaacccaagctatgatgaacaaaaaggagatcacacatatgtgtacaagtttcacgctgactgctcatggacagactttttttgctcggacgatggactttgcatttttgttagacggcgaaccaatcgtcatgccacgggggtatcaatggtctttacaactagggggacaggtcaccaatacctatggctttgttggaacgggcaaacagttagaagaatttctttttattgatggggtcaatgagaagggactaacgattgctgaactctacttttcgaatgaagctgtttattgcgaatacacagcggagaaaataaaccttgcaccccatgaattgttacattgggtattaggaaacgtagcagacatccctgatttgtaccaaaaaatcagcaggatcaatctagtacagatagaaacggcgctactaggtatcacagtcccattgcattttattgtaacggatactaccggaagatgtgttgtcattgaaaccaatcgtggttttatcgaaataaaagaaaatccaatcggcgtgatgactaacagtccagaattggagtggcatgtaaaaaatattggcaactatttagctgcgagacctgctaattttcctcccgcaacagtcaatggagtagaggtgctcccctttggtcttggaaatggaacatctattttaccgggcggattgacttcccctgaacgatttgttcgaaccgtttatcacaaacagtttgtgaatgtaggagagactgccgaagaaacagtcaatgccatgttccatctcttaaataatgccacgatccccaaaggactgatggtcgaagataatggtcaatctgagtatactcagtatcgagtggtctataatgtgacaaatggtacttactatttcaatccttatgaaacccaagaagttttttcattggaattgaagaaagagtggttacaattgaaacagccccggatttttgcggttgccaagagtttcacaacaaaaacgatggtgtaataatcggccacacaacggtcgatgcaaagatagataagtagaaaataacttagtttaacgaagagtcatctctccaataaaaagatccgcggtgtgtcattaccgcagatctttttttcgtgtgatttgccgtcgaaatttttgtagtaggtagctggggagtttatctattctgatgctgaaaaaaacggttcaaaggaaaagcgtattcttatgataatcgttcattgaaactacgagaagaaaacaagaaataatttttttactttcagatattaaaaaaaatctttgaaatacaataagtccagtaatttttttttatttgaaaatagtaaggcgtcattgataacaacactgggaacgtttgtttcagaaatcggctgattcgtgatgatcaaatcaaaggattccaagtcatagttacctaattgctcaccattgatgggcaggatatctgaacgaattttatgcagatcaagaatatcttgaacatagtaactgatgtattgactgtgattgatccccatatcgctgatcactaagatcttttttgacaccaaagtctgattgatctccggaaaagaagtcaataaccagaatacataagaagacaaataactgatgagattcgtttccaacaattcagaaaaaaaatgcagttctgctttgagtcgtgcatacaattggcgctgtgtaaatttgatatgtcttgtaaaaaaagtggcacgctgtgtcagctctgtcgtatcaaagggcagtaattgcgcataggaataaagacaagtcagcaagtgtacaacgaagtcgccgacctcgtctgtgatttgttccaactgcagaaaagtattgaaggtcaaattgtcacgtatcttctcactgatcacagatctattctctgaataaaattgctggaaagcccctttttgaaagtagtcaatgactgtttggcaagactctaaactaataccactcaaatggcgtttaatcaatgaatagtcttcattactgatttttgctttcacggctatcttggtgatagggcgttgccgaaatccttgactctctcttaacaaatcaacgataaaatacataatgaaaaagtcatgttcatagctgttgtccaagctgatactattcaaaatgcagtgattgcgccgcatcacttgttttagttcttgtttatcaaagtgataaggcaaatcacaatggccataatacatcaaaaaaaagtaggtcgtaaatatccgcagagacagctcatcgtcctgactcgttaactgatacccgcgatccacaatgacccgaagtgaataggcagccaacactttattgcaatgttttagttttcgtgcaaaagatgatcgactgatattgattgcctcacaataataatcgatcgttttgcctggctgttgaataaattcatgaaggagttgtgtcgttgttgaagttctcgccatatctgtgagtatttgaagatacaatgtagcattgaaattctctagacgataccctaatttatgcgatgttttgatggttaaaacatttccccagcgttgcttgatctcttcaatatatcggataaacgttgattcgctgctaccaatgtgtcttgcaagttcttttttagtcatccacttatcagaaatggataacacacgaatgatttcttccatcttccgataatttttctccaaaaacctaatcatttcatttcctcccaagtcctttactttaataaaacaatcaacgaaacaataacgcaatctcaataatgaaaccgcttggtatgaaagctggtgtgatttgattcttcccttctatgtatacttaggtatctgattagaataacaaatttccagcatgcaagctattgggatttgctattggttcgcaaatgaaaggggagaatgaaaattaatatactgaggaagttgtgggttttaggagcagtatttatgctggttagctcctatttcacatccataatcgttagagcagaaactattaatggggcagctattctatctgccaaaatcatatcagatgattctgagcagccacagctattactagatgtcgcactcacgaatcaaacaaatgagcccataaaaaaagaaataagaatggatcatgccaagctaaaagaagtagaagaaaaacaagagggatacggttatcaaattaaacacaataccctctatctgacaatagagcctcaactaaatcagaccattcaactgacgctgctcgttgagaaaaattcttttttgaccgagcaagcaccagaattaatttacgaaggtcagatccaaaaggtctctgttgtcatgccgcaggcaacaaaggaaaaaccgactgacacccaggacaatacttctagagcagaaacggatgctgtaaaggaaacagctgctacagatacacattcagcagaatccgaagagtcaaaatcaataaatccatcaaataccaacgaaacgctgacagaaaacagagaaacagaaggacctgaagcatctgaagcatctgaaagatcaacagctgcagatgaagtgataaaacctttttcactccctagcgttgcttctgatccagtgttcgatcgcagtcataaagcaatcctgcctcagtatacgacagatgcgtcaggaacctatccgacagcaagctggcaaccgactgggaatcagaatgtgcgcaaccatcaaggaaacaaagacggagctgcacaatgggatgggcaaacggaatggaacggggaaccaacgaacaaaaccaattcctatattgaatatggtgggactggttcccaagcagactatgccattcgcaagtatgccaaagagaccacgacacctggattatttgatgtatacctaaatattcgcggaaatgtccaaaaggagatcgcaccgttagatttggttttagtagttgactggtcaggtagtatgaatgacaacaatcgaattggcgaggtccaaaaaggggtggatcgatttgtagatacgctagcagaaagtggaatcacagacaacattcatatgggctatgttgggtattcaagtgatggatacaagaatgattcggtcgcgatgggcccctttgattcggtcaaaaatgccattaagacgattactccaagcagtactactgggggaaccttcacgcaaaaagccctgcgagatgccggaaacatgttggcaacaccaaatggacacaaaaaagtgattgttctactgacagatggtgttcccactttttcctaccaagtcagcaaagttcaaacagaaacgaatggcagctattacggcacccaatttaccaatagacaagaccagccgggcagtacttctcgtatttctaacagctactatgctccagaccaaagaaataccaataaattgatcaacagtacgtttatcgcaaccattggtgaagcaatggcattaaagcagcgaggaattgaaattcatggattaggcattcaactgcaaagtgatactaatgcgggattatccaaacaagaagtagaaaacaagatgcggcaaatggtgtctgcggatgagaatggtgatctttactatgaatcagccgatcatgcaccggatatttctgattatctcgcgagaaaagcggttcagatatctggaactgtggcaaacggcaaagtaaccgatccgattgctgaaccgtttagttacgaaccaaatacattaacagtcaaaagtgtcgggtcccttcaagtacaagccatgcccacactctcatttgaagggaacaccgttcgtagtgatgaaatttatttagggaaagatcaagaaattcagatccattatcaagtcaggatccagacagaatcagcaacgttcaaacctgatttctggtacccgatgaatggcagaacaaccttccaacgagtagcaacagcagatgaagtggtagattttggcgtgccatcggggaaagcaccaggagtcaagcttgatttcaaaaaaatctgggaagaatatgatcatgatccgagcagccgcccagaaaatgttatctatgaagtgaccagaaaacaagtttcagatacgacaaattggcaaacaggctacatcaagatttcgcaaccgtcaaatgataccggaagcttatgggaacgcactagtgtaacacagctttcaaagtcagcagatgatgcctatgccgaaaccttaggtctacccaaatacaataatcggggacaagatttcagctatcaaacgactcgagagctaactgtccccggttatgagcaagaaaaagtagatgaaacaacgtggaaaaacacgaaacagtttcagccattagcacttaaagtgatcaaaaactcttctgctggcgaaaaaaatctggtaggtgctgtgtttgaattaactggcaaaaatggccgtacgacattgatcgataatcaagatggcagctactccttgccgcaaaatgtccgactgcaaaaaggtgaaacctatactctcacagaagtgcaagctcctgctggacatgaacgtgggaaaacaacttggcaaatcgaagtcacttcagagggaattgtgacaatcgatggggatgaggtttctacagaagaacaagtgatcacactgaccgtggttaatctattttcagaattgccaatcggcattcgcaagtatacgctgcaagacggaaatgaagtaaatttatctggggcaacattttcgttgcaaaagaaaaattcttcagaccgttatcaaacgatcgctacggaaaaaacaacggattcaggggtagcccattttatattagatcagccaggtcaataccgaatggtcgaagattcaggtccattggggtatgacacgatcgccggcaactatgaatttacggtggataaatatggaaagattcactacgacggcaaaaatgtggataaacaaagtaaagaatggacgttgaatcatcaaaaccagttaaaagcctttgacttgaccgtccacaaaaaggccgacgatcagacgccattaaaagggacggaattccgtttgatgggtccaaatacagacattgaacgatcaggagaagagacggatacgtttgtctttgatcagttacagccgggaaaatatgtcttgacggaaacatatacgccagaagggtatcaaggattgaaagagccaattgaaattgtgatcaatgaagatggctcagtacagattgatggcgaagaagtcgctgatgtgttagttgctggagaaaaaaacaaccagattacactagatgtgaccaatcaggcgaaagttccactgccggaaacaggtggaagtggtcgattagggatttatctactcgcctttagttcgatcgccatcgctggtatctacttatacctccagcgattagaaaggagggggtagcggatgaaaagcatgcgttggtttagtgtatgcatttttctagttgtgttactaggtttctcccaacaagtttcagcaggagaaatgcaagcgaatgttcgcatcacgttacacaaggtactatttcttgaagggcaattaccccaggaacaaatcaattccggagaaggtacattgcttcaagcttaccgcggtttaaatgatgtcacctatcacgtatacgatgtcaccgattctttctatcaattacgggaagatggtgaatcggtggaagctgcgcaaagaaagttggctgagcaaggtcctgcagccggatccctgattgccgaaggaaagaccgagaagatccaaggagaagatggtttacttagcttcacattagcagccaaggacagccagcagcgggataaggtctatttattcgtggaagcagaggctcctaatgtcgtgaaagagaaagccggaaacttggtcgttgttttgccagttcttgatcagaaagggaatcaaatgaccacgattcatttgtacccaaaaaatgaagagaaggcatacgatttgccgcctcttgaaaaagaagtgcagtccaaaacctctgattttacctatggcgagagagtgggttatcagctgtcaacacatatcccagaaaatatcttggattaccaacaattccaactatcggatacagcagattctgccttatttctcttaccagaaacgatcacagtaaaagtaggaacatccgttatgacaggatatacacttcaaataacggatcatggctttgtcctggatttctctattcagcagctagaaaaatttgccaatcaaaaattgcaagtctcttaccaaatgaaagtaatgaatgcagagcctgacacagagatcgtaaatgaagggcaattgctgacagataaacataccatcaacaaaaaagttgacatacggactggtgggaaacggttcgtcaaaagagatagtcaagatccgcagcgaacattggcaaatgccgtattcgtcgtaaaaaatcaaacgggagcctatttgcatgaatcagcccatggttatcaatggcaaagagaaaaagcgggagctaaacgattcacttctgatcaagccggagaattttccgtcaaagggttaaaagatggtcactatttcttggaagaaatccaagccccaaaaaattacttgcttaatcaaaaagccattccgtttgtggttgaaaaaaattcctatacaacaaatggaaaagcagctaccccactggcaatcatcaacaagaaacatactggttttttaccaaagactaatgagcaacaagcaacaggattgatcttagccggtgtagcattgataggttttgtcattgctgggctgattgaccaaaaacaaaaacgaggagaaagaaaatgaaacaagcaaaaaaagtatggtacttactaagtacgctattactaacattacctatttttatcaatgggttgggtacagcagcttatgctgaggaaaatgcaagcaatgcccaaatcgtcattcataaaaagaaaatgaccgatcttccggatccgctcattcaaaatagtgggaaagagatgagtgattttgatcaatatcaaggtcttgcagatgtcactttccgcatttataatgtgacgtcagaattttatgcgcaacgagtagccggggcaactgtcgaagctgcaaaacaagcagttcaaggtctaaccccaggttcgccaatagctgaaggtataacagatgcagatggcaatattaccgtaaatgtaccgaaaaaacaaaacgacaaagatgctgtctacgtcatcaaagaagaaccaaaatctggggtagcggctgctgccaatatggtcattgccttcccggtttatgagatgatcaagcaatcagacggctcgtataactatgggacagaagaattatctacggttcatgtttaccccaaaaatatcgtttcaaatgatggggcattacatgtgaaaaaaagaggtactgctgaaaatgaatcgttgaatggtgcagaattcgtactctcaaaaaatgaaggttccccaagtacgaccaagtatattcaaggggtaaaagatggtctccacacttggacaaccgacaaaggacaagcaaagcattttgttactggtaaaagctatggaatcggcgaagatgattttacagaatctgaagagaaaactggtgaactaacggtgaagaatcttgaagtgggttcctatacgcttgaagaggtcaaagcaccgaacaatgctgaattgattgatgatcaaacaaagacacccttcactattgaagcggataatcaaaccccagtagaaaaaaccgttaaaaatgatacatcaaacgttgaaaaaacaacgcctaatttaaacggcaaagatgtagcgattggtgaaaagatcaagtacgagattgcggtcaatattccattaggtattgctgataaagaaggaaatgccaataaatacaacaaatttaacttagtagatacccatgatgatgcattgacctttgacaatacaccttcaggagatacagcctatgctctttatgatggtgatacactgatcgcatctgaaaactatcaagtaactgaacagacaaacggcttcaccgtcgctgtcgatccagcgttcatcccttctttaacaccaggaggtacattaaaatttatttacttcatgcatctaaatgaaaaagcagatccaacgaaaggctttaaaaacgaagccaatgttgataatggtcataccaatgaccaaacgccaccaacagtagaagtcgtcaccggtgggaaacgatttatcaaagtcgatggggatgtttcatccacgcaagctctagcaggtgcctctttcgttgtacgtgatcaaaatagtgagggtgcaaactatttgaaggtcgatgaagcagcgaaaacagtgacttgggtggcaaacaaagcagatgcaacaacattcacgacgcaagctgatggtttagtcgtcattactggactaaaatatggttcctattatttggaagaaactgcagcgccagaaaattatgtattactaacaaatcgaatccaatttacagtggatgagcattcttacggaaccacagaagaattagttgctcctgaaaaagtgcctaacaaacacaaaggaacattgccttctacaggcggaaaaggcatctatctttatttaggcagcggtacgctgatcttgatcattgtgggtttgtatttcatgaaacgaaaagaaactcgttgattttctgttttgctagattttcacttctagaaaaattggcagcctcaaaagcagatctcagctatttcgacctagtcagataaaaacgggaggttgcaacagacgtggtccgcttcaagaaataagaaaggattttcaaaaatagcttttcccatttttttgaaaagctatttttgaagaagctgattctaaccgcttgttgaaccacttgttcggaaaacggagctgtgacaagtcttttgtcacagctcctttaatttttttgaggaggaaatgatgaaacaaaaaagaggacaccagatagtcgatcgattgatgatccttttgttgttgattggtgtagggattttttcctatccattcattagcgatgcactgaataattatttggaccaacagatcattgcgcattaccaaacagaagcaaatcaagaaaatgccgccgcaatggcgaagttgcaagcgcagatcgacaaaaatcaacagctagccaaagaaggcggctcccccggactggatccattctctgaagcagagaaaatcagtaaaaaaccagataaatcgtattttgaaagccatacgatcggtgtgttaacgattcccaaaatcaatgtacgagtccctatttttgacaagaccaattcagcattgttggaaaaaggcagctcattactggaagggacttcttttcctacaggaggcaaaaacacccacgccgtcatttcgggtcatcgtggattgccgcaagcaaaactatttactgatttgccagaattgcaggaaggcgatgagttttatttagaagtctacggcgaaacactcgtttatcaagtcgatcaaatcaaaactgttgtccccaccgatacacaagaccttcagattgaatctggtaaagatcttgtcacattgttgacctgcactccctacatgatcaatagtcatcgattattggtaagaggacaccggattccttatcatccgaaagtcactgatgacataaagaaagtcaaacagcaacaacagcagtttctgtggatcctcatttttactgcctgcggcttcctcgttttttgtatttggtggtataagcggcgaaagaaaaaaactgggaaccctccagtatctagcagataaaatgagttggctgatcaaagaaaccctgtttttaataaaaaatttttttgatttacagggcataaagaaagctgatttatttgctagccagcacaatctttgtatctcttatgctatcgaacctcccgtaagatgttaagaggattgacaaaatattcgcaaacgctataatgagggtgtattagtggacaaggacgtctgctaatccttttgaaaactagctatcaaagaagatacaataaacgtatacttatgaagtgtcagggaaagaggtgtgaatcctctacagacctacctactgtatggtggatgaaaccaatagaaccacagaatgattctattctggaaggattgggagtaagaagaagctaagtcaggataccggcttgataagtctattcattcttttgtaggaaaaagaaggggcttcgacgataactggcttgatctactgttagtactgttaatgaaccactttttctattaaaggaaaagtggtttttttgttttttgatacaaagtaaaaggagggatagacaaaccgtaggaaagaagaataatcgatttatccgtaagggttggaagaaaaaattcaaaaaaagttgaatgcgaggaaaaaaagatgaaaaaaattctaatgacgatcatgaccatcggagtagttgctgggattggattagcgggttgcggcaaacaagaaaacgaagctacggcttcaactgagaaaacagaacaaaatttgccgacgaaagaccgtagtgggaaagagatctcattgcctaaagaggcaactaaatcgtttcactggttccatcagtaacagaagttattgatgatataggaaaaacgaatgaattggttgctgttgacatgcaaagcgggtcactgaatgaagcgcttcaggcattacctcaaatggatatgatggcgattgatgcagaaaaattgattgcattgaaaccgcaaatcgtctatgtgaatgacattaatttagcaagttctgaaagtgtctggcagcaagtagaagatgccgggatcacgattgtcaatataccgacaagtaccagtattcaagccatcactagcgtaacaacaagtactcagaaaagagccgatagttgtcctattcggacctcctcgatcaaaacaaagtcactatcacgaaagatagaatatgaaatacagcacttgaagcatcttctttattttcctatgttgagagatgacacgtttcctgcagaactatggctgtactttgagaaacaacaagcttggttggagaatatcattcaaggaaaattctcggtgattgaacaagcgattgatcaagagcaagtagtgatagagagcagtcagagaagacaatgggattattcttcaaaggaaatccaacttcaattgaacaaaatcctattcttgttcgaagaaaagcctgataggcgctatcagtatttccaagaatgggcggatgcgttgatccaaacaatgactgtagtaaaactgaactaggagatgaacacattggattcaatcaatgaaattgttgaagaagttatcaaacgaattcaactacaaaatcacacatttgaagtagaagattctggacgtcacgtccatttgtctcgtcgagaaatcgatcatttatttggatcagggtatcagttaacgaaagtaaaagatttgtcacaacctggtcaatatgtatgtaaagaacgaatcactgttgcaggaccaaaaggactgttccaaaatgtcgtgaatttaggtcctgaacgtaaggaagcacaagtcgaagtgtcaatgacagatacccgaattttaggtattaacgcgcctgttagagaaagtggaaagattgaaggaacaccaggggtgacattgatgaatggcgcaacgactgtttcattagatcgcggattgatcgtggcaaaacgacacatccatatgacaccagaagatgccctagcaaacaatgtgactaacggacaaatcgtccaagtaaaagtactaggcacgcgaccattgatttttgatgatgtagtgatacgtgtcagtcctcatttcgcgacgtatatgcatattgattatgatgaagcaaacgcttgtggtttatcaaaaggtgttcatggttacatcattaagtaagagaaggttggacaatgaaagcttctgaaatagaagaactggttcaacaaattactgatcgtatctgtcagcaactcccaaagcctacccttgctcttgctttttcgcaagagaaaaaagagattcctgccgaattatatacccagtttcccattgttcagtggagaaccggtgaagatcaagagtcggctggaatgattgtgaaacaactaacgatttctcaaatgtccagtattgctttactgcaagaaaacgatctattgacccgaagaatactttcatttttgttacaaggaaaaccaattcttgttttagaaactttgccagcaattccgaaagaaacaccgcttaaatatcaagtgaaaaagacaattcaagaatatcgagacaaatgtcagcagtttggtctgacattctatcgctccccgcaagactatgctgatttttggaaatcctgtcagaaaaaatcagtgcctaaggcattgcctaagcggaccttcatcaccgaaaaacaattgaaaaaaatgctagaataccgcattcctccaataaagaatgcgcaattgacaccattagcacaagattatgcgcgcactcaaaagttgcttataaagggggaaaaagcatgcttttaggaaaagttaccggcagtttgtggtctacaagaaaagacgagaaattaaacgggtggaaatttatgatggtagacattttgaatcaagaagaacaaaaacaaggctttattattgcagcggataatgctggcgcaggaattggcgataaagtattgatcagtcaaggcaatgctgctcgaatttctgctgaaaatccagaagtacctattgacgcaatgatcgttggcgtcatcgatgctgcagaggaagaataaggaggttgaatctatgagcattaatgaaattattatgtatattatggttctttttatgatcattggaggcattgataaatgcatcgggaataaattaggacttggaaaacaatttgaagaaggtatcatggtgatggggtctttagcgttatcaatggtagggatcatcacgttagccccggtcttggcgaatcttttaagtcctatcgttgttcccgtctatgaattgctgggtgctgatccggcaatgttcgcgacaacactactagcaaatgatatggggggatttgctctggcacagcaattagcaaatgatcctcaagcagggttatttgctggagcaatccttggggctatgatgggaccaacaattgttttcaccattcctgttgcgttggggattattcaaaaagaagatcaacagtttttagccacaggggtgttaagtggaattattaccattcctttcgggttattggccggtggtttaaccgcaggaatgccaatgtctatgatccttcctaacttgctacctatcattatcgttgctgcattgatcatcgtgggattatggttggcaccaaacggtatgatcaaaggattccagatttttggtcaaggtgttgtcatcgttgcgattatcggtttgattgtcggagcgattcagttacttgtgggaattacagtcattcctgacattgcacctgttacagaaggaatcgaagtcgtagggagcatcgcattgactttagctggggcattttgtttggttgctgtgattacgaaagtgtttaacaaaccgttaatgaaattagggaaagttttagggatgaatgaagtggctgctgccggtatggtggcaacattagcaaataatatcccaatgttccaaatgttgaaagatatggataacagaggaaaaatcatcaacattgctttcgctgtttctgcatcttttgttttaggcgatcatctaggctttacggccggggtagcaaaagaaatgatttttcctatgatcatcggtaaattagtcggtgggataactgctatttttgtagcgatttttatggctaatcgtatgttagggaaaccagaaatagaaacaaaataatgaggtgaaaatatgacagagtttaatcgtaaaatgatcgaaactttggttcgtcaaatcgtaactgaacaattgatgccaacaaaacaagtggatcctagcggtgttgcatcgatcaagctaccagagatcactgtttctgaagaagatcgtttggatacagggaaccccaatgatattgtttatacaaaggatttgttctcactcgaagagagtcctcgtctaggttgtggattgatggtaatgaaagaaacaacatttgactggacgctcgattatgatgaaatcgactatgttatttctggcaaattagatattattattgatggacggaaagtctctgccagtgcaggtgagctcattttaattcctaaaaatagcaaaatacagttttcagtcgcagaagaagcccgctttgtttatgtcactttcccggcagattggcagaatcaataaatttgttgaaaacaagacactatatattttcttaagttgatacgctacatcaggtgttccttttatttatagggacgccttttttttaaaagaccctttagttaattaatatacgtttggaagaaaagatgttttttacaaagcatacgtgccgatctgtaggataaaaacgaagttctatgtaagtagacaggacaaaacaaaaaacaattgaatgagtaactcgtatctattgttcgaaatagttgcaaaaatggtttatttcaaatatctttaaggagcaacatgcattaatcatagaagagtattaggacaaaaggcttggggaagactttttgtagacacctaatactcttcgtttttgtattttatcatgatatcagctagtttgtattaaatggacgaaatttcgtccaccatgttttgataggatcctcccatggtgaattctggcgtgatcgtacaactcaatgtttgttttgttcaggctgatacgtatcttcgatcagtgtgtggtcaagcttttcagtctaaattcaattgcttcatcgtaatcatttatgacaagagcaatattttgtttcacgattactcttcctttatagcgatgcaagtatcattctgagctaaagccaattattcgccacaatagcggactaatggaaatctaaaaaattatcactaaataagccaaataattttatttaacgagggatgtcagccttaaaataatagcgaaatcactaaaaatcggcgggatatagttaaaaataaaatggagaaaaacttgcctgctttacgctcgatctcatatcttcgatcatttctatcagttaaaactcggttagaaatcgagcccaaaatagtccgttagtaattttaagtaaaaaagcaaatagtaataagaaaagggttcccctaataaaagatacgatcactccctcacaatctgatgagtaagagcaaatgcttgctctgaaaagtttgttttatcgctatctgtactattaacctttagtgaatcatttaacttgaaaatatttaaggatgatcgtaagatagttttatcaaatatataaggagtgttatctatggcaaactatgaagaaaaagaatcaaaagcattgttaaaaatcggagaagttttggacaagttagattctaatttagcagaattggattctctagaagcagatgctaaaaaacatagtatgaagaagtggattgttgagaaaaaagcgattcatgaaatcaagaagatcgcacacgaagcaggtaaatacgaaacgtatgatgagaaagaattacaaaaagagttggacgaagtagaaaaatatatgtaaggaagagacgttttcttttcgtttttttctcttattttagttaaaataaatttccagcacactaaggataaatttgcttgatcaaagggaagcccgcttgcttgttttgtgagtaaggaggcttctttgcttatacaagcgactaaaagaatgcatctgtcgcgatgctggtcggcttgactgttaactgataatctcagagaaggcaggttaaaaataaaaaagaagcaagataaacctcatagaaacaaggttcatctcactttggaaaaactacgaaaatcttctcgattttagtctatggagatggcgggagtcgaacccgcgtccaaacatattgctacctaaaaatctacgctcatagtcagctcatttaaggattcgctttacagcttgccgagtgacaggcagtctgtattgctagtctgatgttctcttttttaacttgcagacggaaagttaaaacgtatcccacttagaataggacccttactcgagcacatgggcgatgccgagaggatctacgctaactgtttttaggcagctaaagcgtaagagttttcgtttttagcagttatatttaactgtaacgttttaacgtagacgtaacctacgaagcgcaattcaggctcaactatgcctgtcgaatccgtaacatccccctgataaaaggggtatcgctaccaatcattagtataacataatttgcgctatatgcaaagatttagatcaattcaaaatgattcaaggcatgcacgatgccgccttcagtatttttaagagtaacaaaatcagcaatctcttttagttctggcaagccattacccatggcaattttatagtcgcaagcttctaaaagagcgaagtcattgctaccgtcaccaaagccaaatgttggcacatctttgagatttagtaagttcaccaatgtcttaattcccgttcctttagaggtgccgcttttcacgacatcaattgaaaaaggtgtattgcggtagaaagtcaattcagggaactgttctttatagactgtttcattggcgatacctaatacgagcatcatattgatccggtctttttcataacggaatggatcgatttctggaagggggctgcggacataattgtaagcctcgatcatctcatcattgtgtccagttgcccagtaaccattctcgttataatatgaaagttcgtcgccatgatctctcacggcttccaacatccgtgcgcagagatttttatctaatgtgtctgaaaacacttctttgccatcgatacgaatgaatgccccattcatgacaatatttgaggtgatcccagcagcctcgcgaatagcaagaacttctgtttccgttctgccggttgcaatgattggtaaaacatcattttggcgtaagcgatgcatggcttcagaaatttcgggggtgatctgggagtgttcatctagtagtgtgccatctaaatcaaaaaatgctaaagctttataattcatacagttttctcctactcttattgacagttacaaaatcaatcttaacaaagattgctaaaaacgcaaacctttatgaagaaaccgtgaagttgttggtagataggaggttttcgagtatactagagaaagaatggagtgggaatatgatttttttagtgattggagcgattttctttttgatcggttttgtttttttgattctcccttcaaagaaaatcaattttatctacggctatcgttcttatttagcaaaacagaatgaacgaaattggcagtatgcacaaaagatctgtacgcggtattttctgctgtttgggggagtcatgacattgataggaatcctactgaagtggcagggatggaccaatttctttctcttagaaatgattgcaattccttggtttattgtaccgatttttggtttgatcgaagaaaagctgcaacaatttgatgaacaacataggggtgaagacaatgaatattctaatgattgaagacaatgaatctgtttcagaaatgatgcaaatgttttttttgaatgaaggttgggatgcgactttcaaatatgatggcaaagagggactggaagcttttgccgaaactccagaaaaatgggatatgatcacgctggatttaaatttgcctaccatggatggaatgatcgttgccagagagattcgcaagatttctaatacagtgcccattattatgctgactgcccgtgattcagaaagtgatcaagtgattgggctggaaatgggcgcggatgattatgtgacgaaaccatttagtccattaacattgattgctcgtatcaaagccctgcatcgacggagtgaaattgctgagaaggcaagttctgagacttcagacacgacatttgatatcgttaccgatcactttaaaatgaataccaagactcgggaggcttatttgaacggcaaattgatcgatggtctgacgcccaaagaatttgatttgctttatacattagcgaaaaaaccgcgacaagtcttttcccgggaacaattactagagttggtttgggattatcaatattttggtgacgagcgtaccgtcgatgcgcatatcaaaaagttgcggcaaaaaattgaaaaagtgggaccgcaagtgattcagactgtttggggagttggctacaaatttgatgatgcaggtgctgcctaatgcggtatctttatcaacaattgattgcgttttttgctgtgattctagtcattttgatgacgattggagtagcgtttacccaaatgaccagacagacgttgcaagagcgcaattacgagcaattgatggggtatgcctcttccgtagcaaaaatttcccagatcagtgactcagaattttttcagcagaacatgacgcgagatgaatatttgcagtattcactacatcttgctgaaaatattctgagcaatcaagatatttcttttgctttttttaaaagtccgaaagaacaaatctatccattagatacgtcgggacgagcggtcgactttagcatttcagaatcagattggcagtcattgcaaaatggtggtcgattacaaatgacttcgaataccaatttattcggcgaacgagagttgacttcctatgtgttgattcctttttctgttaatcggacggatttttatggcgtgatggtggtttcacaatctgccagcaatattttgaatctagtcagtgcttttaatcagaacttattcaaagtcttcttgatttcgatcattgtttcgctattgatcagttatctattcgcgactttccaagttcggcggatcaatcggatgaagcgggcaaccaaagaaattacgaatgggaattttgacatctcattacctgttcataatcgcgatgaatttgatgaattggcagaagactttaaccaaatgtcccagtcattgaaagagtcgcatgaagaaattgagcgtcaggaagaacgacgacggcaatttatggctgatgcttcccatgaaatgcgtacgcctttaaccactatcaatgggttgctagaaggattagaataccatgcaattccagagaatcagcgagacaatgcgatccgcttgatgaaaaatgagaccaatcgtttgattcgtttagtgaatgaaaatctggattatgaaaaaatcagaaccaatcagatttctatggtcattaagaagtttgatgcgaccaagacaatgaccaatctgttgacgcaattggaaagcaaagcagaagtcgcaaacgatcgtttgattctggaaacagaggagtcgatcgacgtctatgccgactatgaccggtttgttcaaattatggttaacatactccaaaatgcgattcaattcacacaagatggtgagatccgcgtgcgaatcgaaaaaggctatctagaaacgatcattgagatttctgatacaggaatcggtatgtccgaagaacaagtcaaaaatatttgggatcgctactataaagttgatccttctcgaaaaaatcgacaatttggtgaatcgggattagggttatcgatagtggaacagttggttcgcctccacaaaggtaaaatcgaagtcgatagcgaattggggcaaggaacgaccttcaaagtgacttttcccgatatcgaaatagaagaataagctagaaacatacagtatgcttttttgcagtgatagacaaaaaggaaaccatcgtcatcgatggtttcctttttgtgtacctataaaatagaaaagtctcattgttttgtgatatagggggtatgagccaagcgttcatcttcattcattaaatagatcgatagctgaaattgttttgctagttgactgcataaaggcagaagggcttggatgtcggcggtatgtaaattttttgaaagagtctctaaaactatgaccggtttttccaataaaagtgccagtaacaattgtactttaacttcttctaaagaagtgagttcatctaaggatcttttcaaaaaagtcggttctaaatgaacggcagttaacagctcttccaaaggtttttcttttttattggctaaggaaagattatctttcaatgatagaaaggggacatactgccattttggctcgatggtaaccgcttggttagtttgcagaaagtgtgccaacgtctctttcgcagcaaggtcattggctgcaagatagaaaagacctgggatgtttagttgattttttggtttttccattgctgattcctccaataaaaacagtggctggtgacgacgactaacgtaatgattgagactgaaccaacgagtaggacaaaggtttggcgtaaactttttagaatcattgacaaccattcattgctgttcaattcaacattctgaatgaatgcttggcttgtttgtggaatcgtaatgccgaaatccgctgttgtttggctattgaccgactgccaaatctgcaaggaggcatcttctctgtcgaaagttgtgatatgactggtaatcatttctcgttgaaagaaaggctgaaatagaatcagcaatgcaaagacgaggacgatgattgcaagcagtggcaggaggacttccaagagctgcattcctgcccattgccgcgaggaagctccgctcatcagccatgcctgaaattcctttcttttcattcgttgataaaaaataatgaaacctgtgaaaaccaataggaaactgatgaaaatcaacagaaaaagattctgataaatagatgcaatcggttggatctcttgtgcgatttttgccggcatttcttcaccaatcaaataatctttggcttgcataaataattggttcaatgagtggagcagagtatcactaatgattaaaccaatcacggcaaaaaaggtcaacaatccatagaggatcaatgcttttttatgataatgaatgctggctacagcaaaacgaaaagttttcattcaattcacctcattctactatctagtataaaaggggagtttgaataaagtatgaagttcttgtacaaaaaaaagaaagtcagcggagacttcttgattttttgtgcaaaaaagtaccgcgagcgatcaaacgctagcggtacttttgattgaagcttatttatcggtctctttgaccatttcttcgtattctttataggtcttcgtatgatacaaatcgacggtcgatttctcaccattttttgagaagacactcgttgaatcggcaccgagttctttttctttggcactcagtttttgtaaggcatttttgtaatcatagttatctggatcgacttctttcaatccgcttttcgcatagaagcgcaacagatctccattattgatttgatcagagaccgacagttgcttatcgactttggctttccattcatccacttgcttttgtaagcttgctgaaggacttgggatcgccatgccagtactgttactgtaaaggacgcctccgtaataagtatactctggtgtaacaaagtcaccgtctctaaatgcaacgagctgttcgttttgtttcgagaacaaatcttgtcctaattggatatatttcgaagtatctacacctaacagatgaagtaaggttggtaaagcatccacttgaccaccgtacgtatgattgattccgcccttcgattgtccaggaatatggatcatgtaagggacacgctgtaaggctgcattatcaaaattagaccagctagcgctgtctttaccaagcaattctgctaagtttttgtttcgcgaatttgaaataccgtagtggtcaccgtataagacgatcacagaattatcatacagaccagattctttcaagtagttgaagaattcttcaactgctcgatccaagtagttggcagtagcaaagtacccgttgatcgtttcatcagaagttgttgctaacgggaagccaccttcatcattggtaaattcagagtatgggtagtgattagagacagcgataaatttggcgtaaaatggttgttgcaaccgttccaagtattgcgctgattgttcaaaaaatggtttgtcatgcaacccatattggaatgagttatcttcgttgacatcatagtaagaagcatcaaagaagtaatcatagccaaagcgtttgtaagtctcgtttcggttccagaaggtaccagtgtttccatgaaaaacagctgatgtgtagccttgtgtttgtcctaaaatatctggtgctgcttcaaaggtattcttcccgccaagttgcgtgaagagagccccttgattcaaaccaaagagtgaattctcaaaaagtgtttccgcgtcactggtttttccagctttgacttgatgaaagaaattatcaaagctaaatgtgcttttactatgatacaaacgattaatgaatggcatcacttcatgttctacgccattctcatcttttaatttataatcgatcagaaattgttgtgtactttctaaatggacataaatgacattttttcctttagcgatcccgaacatgtcgtcattaggttctgcataatgctgcttgacataactttcgacttcgttcatatcattgggactagcttctgctcgaacttgagaagcttgatacgtctgcacgccatcataaacagtaaatgcattgatccctaaatatttgaccaggtaatcacgagaaaaagttctagtcaataattctggacgatctgcttcggctaagaacaaatttcctgagaagatcattactgctaatgttgaaatggcaaaagccatccgagctttaacgggacgctgatccattttgattttcttcataacgagagcggcaatcaaaatgacgaagtccacgaagtacaataaatcgtaaggtctgaaaagacgaatcgcactttctcccagaccactagcaacttttccggcaccaagcatcgtattgatggtaatgaaatccgtgaactctcgataataactgacatttgagaacagtagcagtgtcatcaagaaatagatggcgatcatggtgatataggctgcttttgttcgtctcacatacagtgcgatcgaaagtaaaaataaagttgttgcgattggattgataaataagatgaagtattgcacagtgctttcaatcccaaggtggaagtccaccaaataagcaaagatattttttaaccaaaataatagggccaatatgaaaaaaaagcccattcttgtattcacaaaagtggatactctattttttttcaaaggaatcttcctctctctttccagcttaaacgaataagattcgaatttacatcatcctatattctactagtccatcgaaacagtgtcaatcgaattccctgtcgtggtgcggaattaagtatttctttactttcaagattacagacaaagaaacaggtttttgctatacttatcaatagaatgaatggagcagataaacgatgaaaatgaatttaagcaaaaaaggaatcaaaaaattccataaaaaaaacccattgatccaagaagatgatctcctgcaagtcaaagatacacaggattgggtctcttttgtcgattcgcaagggaaaattgtcggaaccggctatttagggaaacagaataaaggcatcggctgggtattggcttttgaagatcgtccgatcaacaaggacttttttgaagcagcttttgcaaaagccaaagccaaaagaagtgcttactatgccagcgaagaaacagatgcttttcgtatcgttaatggagaaggtgaccacttaggtggattaacgattgatctctatcgagaatttgccgtattttcttggtataacgaaacattgtaccaaaataaatctctattgatccaagcgttccaacaagtttttccagaagtcaaaggagcggttgaaaaaatccgctttgactctgatctgccagaatcagcagccgtctatggagaggaggcgcccgaaccgctgattgtgaaagaaaatggcgttcactatgctacctatcttaatgagggactgatgaccgggattttccttgatcaaaaggaagtacgcggacaactcgccgaagggctgtcagcaggcatgacagtgctcaatatgtttagttataccggtgctttttctgttgcagctgcgatgggcggtgcgacaaagacaacgagtgttgatcttgccaagcgcagtttggagaagaccaaagagcagtttgcaatcaatggctttgatccagaaaaacagaagattcatgtgatggatgtttttggctattttaagtatgctaagaaaaaagagctgacctttgatatgatcattttagatccgcctagttttgcccgcaacaagaaaaaagtcttttctgtcgcaaaaaattatggtgaactggttacggatagtttggcgattatgaacgaggaaggcttgttgattgcttccacgaatgctgccaacctttcccaaaagaagtttcaacaaatgatcgaagaagcaatggatcaggcacaagtcacatatcaatgtatacaagaatatcgactaccaagtgattttgcagttgatcctaactttttagaagggaattacttaaaagtattcttttaccaaatcaaaaaggagtgagacggatggttcaagtaaagtcaatcgagttggatggcaagcacccgcgcatttgtgtgccgctgaccggaacaactaatgaggagattatcaagcaagccctagccgcagaaacttcggatgcagagatcattgagtggcgggctgattattataaaaaagtcgatagtttatccgacgttctggatgtactttctcacgttcggaccactctaaaatcaaaagtttttctgtttacgtttcgaaccatcgaagaagggggacaaatctctttcactttgacacaatataaacatttatgtctaggcgttgcagaatctggattgatcgatatgattgatatagaactggaaaaagctgagtttttaggcagaaactttattcagaaaatcaaagaacatcaagtgaaattggtgttaagtagtcacgatttcgacaaaacaccagaagatgctgtgttgatcttaaaaatcgggattatgaatcaatttggcgctgatatcggaaaactagcaatgatgcctcacaatgtgcaggacgttttgcgtttgatgggcattatcaataaagcgcggggattcaatcaattacctttagcagtcatgtcaatgggaaatctaggcaaaatcagccgcgtcagtggtagtctgatcgattcagtcatgacttttgctgcgctggatcaagcttctgcccctggtcagattccagtggagcggatgaaagattatttagctgagttttcaatcgaaacaatgaaaaattaaacaatcgggaacataaacagaaaaaaatgggacagactagtcctatagtttcgagcagtcttaaatgagactcttaaaattgaagttgtaaagaaagaaccagaagtttggataaatgaggaatgcgtcatggcaaaagtaaaaaaaacaaatgcgattcggatggtagaacaaaagaaactctcctatcaggaatatacgtacgaatggtcagaagatcatttggatgcagggtctgttgctcagcaaatcgctcatccagaagccatctataaaacgctggtagcagttggcaataaaacgggtcccatcgtcgcagtcatccctggagatcacgaattagatttgaagaaaattgctaaagccagcggcaacaaaaaagtagaaatgttgcacttaagagacctagaagagaccacagggtatattcgcggtggatgttcaccgatcggcatgaagaaactctttccaacctatattgatgaaagtgcgcgacatttggaagaaatcatcatctcagcaggaaagcgtggtttacaaataggactgtctccaacagatttgagcaaattagtccgcggacagtttgtctcgctgactgctatttctgaagttggctaaacaggaacagacaaaacaacagagccgctgcattnnnnnnnnnnnnnnnnnnnnnnnnnnnnnnnnngtttgtaatttttaaatcatatcagattaacaagcgaatgtcaactctttttttaaaagtttttttcgaaagtgtttattcaacaacttcctgtgcgtcatcagcgactccattagaataacaaatgaattgttatttgtcaacaacttttttcaatcttttttgttgctgcatcagcatcaaattgatttcttaaatttgcgacttcgttataatatcatctgtttccgttttggtcaagcccttttttcaaaaagtttttttgaaaggttttgactgtcggtgtgttttgccaacgttgataaatttaccattattctctctgagggtcaagcatattttctgtttttctccaataaattttctgaaaagaaaaaaaagccgtatcaacggcttttttatgtagttgtcttctatccatttgattagaagaatggcataccttctattttgtaatcttcaataatttgtctgaaaacattcggttcttcccacgcataaccatcaggtagttgtttgtcttgtcctgattcttgggtttcaaaaacaaaaagtggaatattctcagcatcaatcgatccattggttaattcaacaagatcgatcgctgtcacgtctaaatgaatactgtctttaaacaattgtaaaatatttgctagaccggtcttatcttcagagaagtctgtagatgccagttctgcggtaccttcgtgcgtctgcatcaaaaactttttcgagccatttgccaagtgcatcataactgttcctgccacttttttggatcccaaaatacccacctcggttattcaactgattgtaaatcaattttagcacattttcagaaaatatgcacgattatctctttccgttttctttttccagcatctctttggcttctgctgtccactttggtaaggcttcagcaatcgtccgaaaaccgattcgtttgtttttattcgtaaaataccttttgcgcttataaggaagctgaacaaatttttgttctaatgttctgcgggacagactgattttttggctatattcatcgatatcgataatctgtacgcgcacctcctggcccacttgcaaaacatcatgaatattcttcgtgtatccagactggatctcagaaacatggatcaagccttgtgtttctttatcgagcgacacaaaggcgccgtatggttgtatacctgtgaccgttccgtcaataatagttccgatttgatagtccatatgatttcctctcttttcatcttttattatacttgaactagtgttagatttgaagtagtagaaaaaaacgatctaggaggggtacatatgacgaattttgacaatgtccattcacggttaaataccaatagtgtaaagtgggacagtattgctacgacctataaggaagaaggtttactgccgttatgggtagccgacatggattttttggcacctaagccggtcaagaatgccctgcagcaagtgattgatcaaggaatttacggctatactgttttccctgaaagtttgtacgaagcaatcatttcttggcaagaacgaaaacacaactactcgctacaaaaagaggagattttgttcaacagtggtgttgtccctagtctcgcattagctgtgcagagctataccaatgaaggcgacagtgtaatgattcatgatccagtgtacccaccatttgctgacgttgttgaaaaaaatcagcgtcaacttgtgcgcaacccgttgatcgaaaaaaacgggcatttcgaaatcgattccgttgcaatggaatctgctattgtagataaccatgtcaaactgatgattttgtgtaatccacacaatcctggtggtcgtgtgtggacaaaagaggagctgcaaacaattgggtcgatctgtcaaaaacatcatgttctcgtggtcagcgatgagatccatcaagacatcgtttttgctccgaatacatttgtttcatttcagacagttgatcctgtttttgctgatttctccattgttttaacttcagcaaccaaaacattcaacttggccggcatcaaaaattcaatgatctttatcaaaaatccggatttgaaaaaacaattcataactgttcaagaaaaaaatgttcaaagtgaaatcaatacattcggtattgtagcaacagaagcagcctatcgagagtcagaagcatggctggatgaattgcttaactatctttcagccaatatcgaatggacctgtgagtttttggtagaaaaattacctgaaatcaagtttcaaaagccagaaggcacctatcttatgtggctagacttctctgcctacggtctttctgaccgagagttacaacgcaaattgatcaaagaagcaaaagtggtcttgaatccaggtatcaactttggcccatccggaacgcaacatatgcggatcaacttggcttgtcctcgagaaacgctgcaaaaaggtctcctgcaaattgctgctgcattcacagaactgaaacaataaaaaagaaccccgcggggttcttttttatgcactgatttcaattgtttcgatcacaacatcatgaacaggacggtcttgcggtcctcgttgaacgtttgcgatttcgtccactacatccatgccatctacaacatgaccaaaaacagtgtgacggaagtctaaccacggcgttccaccttgttgatatgcttcgatcacttcggaaggataacctgctccctctaattgaccaagcatattcgctggtacgttttgattgttgacaataaagaattggctgccgtttgtatttgggccggcattagccattgataatgctccgcgaagattgaagagctcttttgaaaactcatcttcgaagctgcccccgtaaatactttcgccacccataccagtaccggtaggatcgccgccttgaatcataaaatcaggaataacgcggtggaaaatgataccgtcgtaatatcctttttgggcaagttcgacgaagtttttcacggtttttggggccaattctggaaagagcactactgtgatatctccccgattcgttttgataactgctttatgacctgtttcttttaaatgtagctgtggaaattcagacacacttaacgcctccttgtttatactaaatactaaaacaatgatagcagaaaaatgaaaaaatgctagttaagacaatttttgctataatgaagctattcgtccaggtgatactgtagaataatcaatcaacagagggagatgcactatggagatatatgatattaccatcgttggtgctgggccgagcggcatgttctctgccttctacgccggtatgcgcaacgcaaaaaccaaactgatcgacagtctgcctcagctaggcggccaattggccacgctctatcctgagaaatatatatatgatattccgggttatccaaagatcaaagccggtgaattggttcaaaatcttgaaaagcaactgactaccttcaatcatcaatactgtttggaggaaaccgtcttacagatcgaaaagcacgaagactacctagaactgatcacagataaaggcaatcactattccaaagcagtgattttagccttaggcaatggttccttccagccaagaaaactgtctatacccgacagtgaacgttttgaaggcaatggactcgactatttcgtaactgacttgatgaagtatgcgggccgcaaagttgctatcgctgggggtggcgattcagcgattgactgggcgctcatgcttgaaccaatcgctagtgaagtttatttgatccatcgtcgcccagaatttcgagcgcatgaacatagtgtcaacaaactgcgcgcttcttctgtcaacattctaactccctatgttatccaggatatcagtggagaaaaacgtctaactgaaattgctttgcagcaagtcaaaggagatgaatctgtttccttgcaagtggactctttgatcgttaattacggtttttcttcgactttgaacattaaagagtggggactaaaaagcactcgacaaggcgtattcgttacatcagatatgcggacatccattccaggaatctacgcttgcggggatgtggtcttatacgatggcaaagtagatttgattgctactggtttcggggaagcccccactgccgtcaacaatgcgcttcattacattgatcctaaaaaccggacacaacctgcccacagcactagtttgttcaaggagtagaccatgctgagtcggtataaaattgatttacctgatgcgtcccttgcaaaccaaatgcgtgtttacttagaagcctttgaccaagtatcgactgtccaacatcatctcgaagtagccaatgccgctgagcaacttgccaaacgtttcggtggcgactgccagaaagcaacgattgctggattgtttcatgatatcagcgtggtcattcccaatgatgaacgtctcgcatttcaagaatattacggtttggagatagtgccggaagaaagaaaagtaccattattgctgcatcaaaaacaatcggctactttggcaaaagagctctttgggatcactgaccctgagattttgtctgccattacctgccacacgacacttaaggaaaatttttcaaagctggatctcattgttttcctagcagataaaatcgaatgggatcgcgcagatgcggcaccttttttagaggagctactggctgcacttgataactctttagaagcggcagcattatgttatcttgactggctgtttgctggtgatttgctagtggcccacccttgggcagttgccgcaaaacaacaattgcaaaaaaagctacttaccaaaaaagcaaaaactactatattaaaaaaaccaaaaaaagcaaaaactactatattaaaaaacagcttaaaaaagagctagtataaaaaaggaaaaaagctataaaaagaacggtcgcaggatttctctgcgactttttttcatacagttcagaaacgactacgttgctgttcgtcggtattttttgattccacgggcaagataagataggatagaagtaagaaaaaagaattggagggaatcacatggtattagagaataaaacacttgaagataaggcaagagaactactttcagagcgcggcgtatcacttcaggatatcggcgaacttgttttatttttacaaaaagattatatcgaaggtattacattagatatgtgcattgaaagtgtgaacgcagtcctcagtaaacgtgaggttcacaacacgattttgactggtatccagttagatatattggcagaagaaaacagccttttgcatccattgcaggaaatcgtcaaagatgatgaagggttgtatggtatcgatgagattttggcactttccattgtcaatgtctacggttcgatcggtttcaccaactatggctacatcgataaagtgaagccaggtattttaaaagaattaaacagtcatgaaggcccccgggtccatacattcttagatgatattgtaggtgcaatcgcagcttcggcagctagtcgtttggcgcaccagcatccaagcaagtctcattacatcactcaataaacttgtaaaaatcagctactatcgaaaaaagactatcccacaagtctgaaacacctgaagggactaccgtgtaaatcgttacgcgatactagcaaggaacgccagtatgactgacgttcccgctatcctctaggtcttttctcacttatgaaatagtctttttttgactttgttttgcccaccagtaaatcacaaagaaaaacagttcaatcagtacaaaaaataaaataaaacagtgcatgaagaacgtctccggcagaacattgatgatgggatccgttactggatcaaaaagccaatcgtcattattgaagaaaatctcatgaaacgtcacaaaaaatcgatcaaacccgattgccatcaagaaaccaaagaaaatcggcagcagcatcccccactgcaatggtcgcaacaaccgccagcgctggtcatttttccaaaaagatctaagaagcatgaaactggggatcaacgttacgagcagtacaccatagtttaataaaaatagtttcttcacatcatagaaatgtccagctcctgccgctgacatcggaaaatctggcaaagctaatgtcgtattcaatggattgttcaagaaatccagcaacaacccataattttttatcaattcttcttttgaaatgtcggtataatctaaaatattcaactgttgaatatcaaaatgatatagccagcgaaaattgatcgttaccgtaattgctaagctgatcagaaataaaaacaaacacagcatccctagccgctcgatccatacttgttttctcattggtcaaaatcccattcatctaaggaatcaatgacataagttgggggttccggtaaacgaggcacagcagatttcggtgtaaaaccggatagtaccaatagggaatcaatgccattccgaatccccgagcaaatatccgtctcatagttatctcccaccataatgacttcctcttttggtaaaccaaggtgtgccacggctttgtccataataattgcttccggtttaccgatgaaaatcggcggtgtctgtgtcgcagtctccaccattgcgatcaaagaaccggctccaggtaacaatccccgttcggtagggatatttttatctggattggtgccgataaaggtagcccctttttgaatcgctaatgtggctaagacaaacttttcgtaggtgacatcattgtctaaaccaacgacgacataatccggattttggtcatcccattcaaaaccggccgctaaaatcaagtcgatcaatcctgcttcgccgatcacaaagactttattgccgcgaccgtggtctttcataaagtcgatcgtcgccaaacttgccgtataaattgttgcaggcgccacatgaatggcgaattcatccgctaatcgttgtgcgactgtttctggactgcgggtcgtattatttgtgacaaaaaggaaaggcaattcctttttctgcaaagcttcaacgaagcgtttgcctgctggtatcggctctttccctaaatagatcgtgccatctaaatcaatcaaatatcccttatatttcataaattactcttcccgttgacggatcgtgaattcttttttatttgtttttttcactgtcgtttctgtcgatcgcgcctttttttcttttggttttcgatttttaatcgttggcttcacctgcttttgagaaacaacttcttgtttctcatcgatgtgtgccggacgtgtttgattgatttgagctgctggtttctttttacggcgtcgggtcgtactcttttctttcttgccgccaactcgttgaattacaaaataagcgcaaccgaaattacagtattcatataaataatcctctagcatgtcgatccgctgatccggtaatgctttgcgattgtctttgtcaaaaaaaccttttagacgcaactgttcataaccccaatcccctacgatgtaatcgtagcgagccaatacttcactgtaccgttcgcccaatttttggggatcaaatccttcgcgataatctaccaccaatttgtattggcgtgtaccgatcaataattcatcttcattaacaagcgtaaccagttcgcctttttgcggctgtttctctggttcttcgatgatctcctcgagtaccgaagtgatctcgtctgtaattgtttgtttttcggtcatcttttcaccacctgttgtctattataccttgttttaatacgtaatgatagtcgtgcttgtatcagattcccctccgactttttcattactggatcggatatttatgtgctaagtagctgccaaagaccgtacgaataaattctggaaataaaaattcacagcgtccggctatctcgatcgtgggaaaaaaaggaataaacaaataatgatccactaatgtgatctggtattcttccaccggattgattactttgttttgccacaatacttggtgattgatggcatcataagagatccccttataaaccagttcaccaaatattttcccacgaaatcccatcccaacaattggatagttccgtaaaaagcgccgatttttttccatttctaaaacaaaacggatcacatctgctcccttcaatgtcactcgaatcaagtgcatcggatgaggcaagatggtatgcagttgatcctggtcgatgcgccctgccggtaaatcacctaaaaacaaaccgctattcaacacagcagcttccgtttgtcctctaacacaaagcgccgccaatgcttcttggataatcgaatcttcgttcccttcacaacgaagcgcccacggaagttgtgcgacttgtttcgttttcagcaaacgatgaccaatagaaagataaccagcaatctcttcttcatcttgcggaaaagctaaaagctgctctgtagggatcactcgggcagaacgctcgatagtttgcccttgatcatctaacgtaatcgttacttcaccaatataaaagccaaatttccccgctgctgccaattgtacgccattgacgatttcgccggtctcgaataagtgatgcgtatgagagcctaaaatcacatccaactgaggaaactcagccgcgatcgctcgatctgcattgattcccaaatgactcatcaagactaaaatatcgacttggggctgcaaatgattgatcaataaaggcagcaattccaagggttcacgaatatcccagccgtttggtgaataggtcaaaggaaagggtgccgtaaaagcaatcagcccgactttcgtcccttgattcgtttcgatgatctggtaatcctgccgccattttggtggtttcaaatcattcttatcgaaaaggttcgccaataagataggaaactccgcttgatcataaagatgctgaagctcttctttggaatttcccacaccttcattgttgccaatagtcactgcatcatagtgtccttggttcatcagctcaatattggcttgtccgttcgttgcttcagtcaatggatgccaccgatccacaaaatctcctagatccaaagaaatcactgtttcttgactcgaatctgcttcttgcttccgttgattaagataacggcggatcttaggccaatgctccagatgtgaatgcaaatcattcgtgtgtactagcgtaattttttccatcttatccctcttctcacccatttgctgtcggctatttgataagtcttcagcttaatgttccaactactattagaatagcacaatttttgcgaggtaccagagggatgcttttcgattcaggttttgtttccagcgtttggaccgcctttctaaagaccttgtgctacaataaaaaaaaaggagggatttcgatgttagaacagttacgagcagagtgggaaaaactttttggccacaagtacacttcttcctctgagaaacaacaaacggtggatggagagacctcccatcgtttatccgacgaggatccagagacacttcatgagatgatggggacagattggaacacgtttttagacggtagtgatatcttcactgaattatccgctgaagaacaagaagagatccgcaggaatggccctcggcatgaagactatatctaattcgatctgctacaaacaataatagaacccctcgcttataggtgtagtggttctcagactgcaactaacttcattcgtgtcatgaagtgctgtatatctgttggatatacagcacttcgtttttatcttttttctttaatataattaaaaaaatcggaggttttggaggtcaagaacttgaaaattatagaggtaaaagaaagaacggcaccattgatagaacagctattaaccatttgggaaagtgctgtaagagcaacgcatctctttctatcagatcatgaaatagaagaaatcaagacgtatgtaccacaagcattaaaagaaatcccctatttaattctcatagaaaacgaaaatcaagcacctgttggctttatggggatcgtggagcaacatcttgaaatgctttttattgctaacgaagaaagaggaaaagggttaggcaaagaattgcttacatacggcatagaaaaatatttggttaataatttagcagtgaatgaacaaaacccgcttgcaaaagatttttatgaacacatgggatttgaagtttataaaaaaacagcgtttgacgaacaaggcaatccatatccactaatttatatgagattagacagataactattccagtagttactttttagcaagaggttatgccataagtcatcatccaacaagtgaaaccgtatcatattctattgcgatagattcctctgacttttgcgacgaggaacccctgcaccgcaagagcaatactatatcatgttcggatttcacttgtaggagacttatggcacagcccctttttttatttattattgaatgaaggatataaaaaaagggcgtttgtctaccccctcagaagaactcacttagagaagtcgcagttctgctttttggcaacaaaaaaagctgattttcatcagctaatagttaattaaaaaaaatcagacacatggagactcctgcttagtgctgcttccttccggatctgacacgcttcacaagacctccattgtcctagcctttcgtatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctccctcacctcctataggtttcattttaacgtgcagtttttatgagcagatctgttattactgtacaaaaaaagccaaacacttgaatgtttggcttcttctttatcgttaaacgatcttattcgtctaatggtagttcttcttgcgcatcttctgtttcaatgaccgtttctccggtaccaatgccgtacgcatcgcgaacacgagcagaaacttccatcatcatttcttgatgttcacgcatatagtttttcgcgttttcccgcccctgaccaatgcgatctcctttataagcataccaagcaccgctcttatcaacaatgtcttgctctactgccatatcaagcaactctccctcttgagagattccttgtccatacatcatgtctacttcagcaactttaaaaggtggcgctactttatttttgacaactttgatttttgtccggtttccgataatgtctgttccggattttaattgttctgcacgtcgtacctctaatcgaatcgtcgaatagaatttaagcgcacgtccaccaggagttgtttcaggattaccgaacatgatcccaactttttcacgaatttgattgataaaaatcgcaattgttttggtcttattgattgatccagataatttacgcaatgcttgagacatcaaccgggcttgaagaccaacgtgggtatcacccatctcaccatcgatctcagctcttggtaccaaagcggcaaccgagtcgataacaacaatatcgacagctccacttgatactaaagcatcagcgatctcaagaccttgctcacctgtatcgggctgagatagcagcaaatcatcgatatttacacccaatttttgtgcatattgaggatctaatgcatgttctgcatcaataaaggctgctgttccgccacctttttgaacttcagcgattgcgtgtaaagcaactgtggttttaccagaactttctggtccatatacttcaacaatacgtccacgtggataaccacccacacctaaagcaacatccaaagccaatgaaccacttggaatcgtcgaaatttgttgatcgactttctcaccaagtttcataatggcacccttaccatagttcttttcaatctttttcagtgcagcatctaaagctgctttacgatcatctgccaaacggataatcccccttattttcttcactttcgtgtgtcaattactatgttaataatagtccttcttttaaaaaaatgcaagaaaaaacgaacaaacattcgcatcatcttaacaattccttacgtaatagatctaatcctgccattactgcactatgacgaacgtatgcacgatctctggaaaaatgatagcacttgcttttcacaccttcattggttgctaaagcaatccagaccgttcctgggcgttgattctcaagctcatctggtccagctaccccggtaaaagaaagggcgtaatccgctttttctttggcttgggcagcaagcgccatcgcttctgcacattccttgctgacagttccataagctgttagcaagtcttcattgattcctagcatcttactttttgtctctttagcataagtcacataaccaccagaaaatacacgggacacgcctgagatgtctcccagcgtcgcttgaaagagtcccgctgtcaaactctccgcagccgtcacggtttttttcttttctttcaacatatcaacgactacttcagctaatgaagtatgctctccatatccataaaaatattcgcccactcttgcttggatttgttgttctaattcatctagtttggcttgtcctgccgattcatccgtagttttcaccgtcaaacgcaaggttacttcattgggtttagcatacggtgcgaccgttgggttcttctgagaatcaattagatcggcaagttcagttactagtgcggattctccaattccataaaatcgcaatactcgagaaatcaactgttcttctgatgaaaactctgtctgcaaaattggacgggcttgttggataaacataggtttcagttcacttggtggtccaggcaacaggagatatgccgctgtagctgttcggtagaagataccgattgctaatccagttgcattaggtaacgctgtaccatctttgaataccaacgtctgcctcaaattattttctgtcataaaacgctgaccatttttgaaaaaggtcagcatttgctcataccctgcttcgtcacgaacgagctcttgaccgacatgctgtgcaacgatttgtttggttaaatcatcttctgtaggtccgagaccaccgcaaaatacgatcaagtcactgcgattctcggcaagtgttactagctcttccaaacgctttggattgtcccctacaacactatgatagtaaacttcgattcctaaactagctaattcttctgataagaaagttgcattggtattcaccacctgtcccaaaagcaattcggtccctactgcaataatctctgccttcatttcattactccttcattatcaactacgttgtaattgattttttttacaaaaaaagttcagaattcctctgaacttttagaaattacattgaacctttaaaaacactggcatttttaatgaaataatcgattccagaataaattgtaaagatcaaacatacatacaacatgatttgatccaatggaatgcctatgagtgaaaaaggaagattgttaataaataagaaaataatggcaaccatttgtgttgctgttttgattttaccaggccaagcagcagcaagaacttcaccatgatgctctactaacaagagccttaaaccggtgactgctaactctcgacaaatgatgatagagactacccaagctggagccttatccaattcgactaacataataaatgcagtcattaccagcattttgtccgctaagggatcggcaaatttcccaaaattggtaaccaatcctctggaacgagcaatcttaccatccagccaatccgtaatgcttgcaacagcaaatagaatggctgctatcagatgtgttgtgagtaaatcgacgcctccaacgtccaatgttcctaaatcgattggcaacgccaaaactaaaataaatataggaatcattatgatgcgtaatacagttaattgattaggtaaattcaaaaaatttgctcctctctgacaaatattgtacgaaaaaaacggaaatcatgctactacagcacttgccataggaacaatgttatctttctaactaattaatcgttcttctgatcagtttgtttcttgatactcaatcgctaaatgcacatttttttggagcaatttatactgaggatcatcgaaatcaattttttgcccgtttgccgcaatctggatattttgacttgcaccaagtacaatggttgcattggttgcattttctggcaatgtcgtcgattggacttcgcccgcttgtaaagtatattggtagacatacgcattgtctacaagaatgcctacccaacacgaggcatctaatccagttaactctaatttaattggattcgtcgcatctttaattgaaatgctgatatctgattgggaagattcccctttggtcatagtcatttctttctcactagattctgtgctgctagaagattgagtctctgactcgctcgtttctttgcttgctgtcgattccaccgtgcttgaggttgatgtataggctgaattctcaaccaccggtgccgaactaccttgaatcataggggttgaatgtctgtcttgccaagccatatacccaacaatacagataatagtgactgctactaatcctaataaaatcattggtaagtagcgggataaaaacgttccgcctttttcctctacatgcaaagcttttctcgatccgcttacggtctcaggttgaggtcttttaggcagtggttctgccaatgtatcttttccatcaaatacagaaactaacttatctccgtcctcacctacagcggcggcatattgacgaataaatgcacgaacataaaaagttcctggtaattgttcaaaacgatcggcttcgattgcctccaaataccttttttgaacttttgtcatttgctgtaattcatctaatgaaatatgtttatctaaacgggcttgccgtaattttgctccaatcgtagtttcgttggccactcgatcatctactccagtctttactattcattttatggaaggcaaacacttggatcggaaatccacttcgtttctccttgtcatccttggattgcttaattgataggttgtttattaaatataacatttttactcttgatttttcatcataaatgaaaattgttcaatcagtatcatttaaagaataccataaaaaaaattgactgaggataacattcagacaagtcgcaaacaaaatttaatactttttgatctcattactcattcttctacaaaaacaagagccatctatcagaaaatgcatagacggcatcttacacaatgacgattaatcagttagttttagttggtagcaagtaaaaccgactgaatgctttttgatcaatgaatactttagcagcagatcgaacatcattgagcgtgattgaacgtataacatctggcaaatcaaagagtgttgtttcgccaaataagctttgtgtaaattgattagcaataaattctaatgaattgagagattgaaaatatttacccagcatttttttcttaagtaactcaagattcttctcgttcatttcaggatcattttcataattcaataaaatttcttcaaccgcttgaagcatctcttcagggtattctgcatctccagaaaaatcagcaaagtaaaaacttcgatccaaacttacttcgaaaccaaacgtatcatcaataattccttgatcatacaaccttaagtaattagctgaagtattacctaaaagtaattggaacaataaattcaaagattgtttatatcgtagcaactcccgaccttccgtcggacgtttctccatattccctttgatacccaaaacaccttttggtcgcgtaacgggcatcctcataatactttctggaataatttcttgaacggtttcttccggaaattgacgcttaatttcttttgctgcagaaaaagtttttgctgcctggttttctctgatccagttcattgtctcttctggatcgatgtttccaactatgaacaaagtcatattgcttgggtggtagaatgtatggtagcacagataaagatcttctgctgtgatggctgctatactttcaacagtcccagcaatatcaatgtgaagcggatgctttggatatagattcttaatgacaccaaaaaattgttgccagttaggatcatcatcatacatctgaatttcttgcccaatgatccttttctctttctcaaccgtttctttcgtaaaataaggcatctgtacaaaatctaaaagggtttctaaattttttcgaatttgattggtagccgaaaaaagataactcgtttttgtgaagctagtaaatgcattggctgatgctccatgttgcccaaatttttgaaagacatcaccgtcttctttttcaaaaagtttatgctctaagaaatgggcaataccatctggtacagtatgcatcgtttcattcgcataaccaaaatgattatcgatagaaccataatctgtactaaaaagaccgtatgttttatgaaacccttctttaggtaataaataaactgttaatccattgggtaatatctctttatacaagacttcatttatttgattataatgttttttattcatgatcaagctccttatctaaaaagaatacggcttgaagttcgatcttttgagcaattttttgaacatctgtgaccgatacctcttccaaacgctgtataaattgctcttcactcattttagtattcggtacccactgattaagatattctgtttcaatcaaagactgtggactatccaacgataacaaaaactgatttttaagcatagcttttgtctgtgccaattcagcctctgtaatttctcctctttgtaaactttgaagttgttgttcaatcaaagtaaagacttgatcccggttactgccatcaattcctgtttgaacagataaataacctcgaaatgtatccacattacttgatgcatagtaagctaagctctctttttctctaacattcataaatagttttgaatgaggaaatccgccaaataatccattaaaaaccatgagagagaaacgttccggttgattataataaacacccgtacgataacctaagttcagttttgcctgagtcacaggctctctgacgattttctcgcggataatattttccaaatcttgacgataaaaaacagaaagatctttttcaggacgattttcaaaggggagatccttcataacttcaattacttgatcttcttcgacatccccaatcacaaaaatatctacagcatcttctttaatcatagaactatatgtttctgttagttcttttgccgtcacatcttccaaatcttcaggacgaccaaaacttggaaatttttgattgtcactttttgaaaaaaataattcttgtaagcttaatgaagcaaacgcctgtttatcctcagcaatacttctcatataagcaatcaaattgcttttttcgatcgtaaaattttttgattcaaattcatcttgaacaatatttgggaaaaaaagcacttctttcaaaaaagaaacagcttgggtaaatagttcttcatcagcaacatattttccgttgacgaacgacatcgctgcattgacttgatgaagatccccttttttattaacattcatgccaaagcttgctccatacaattctgccagttgcgtactaaaggctgtttgagtgggataacgcaaactagttgtctctaataaactcgtcaataatgtgcgtttcgcagccgtttcagccgctaattgcgaagtaaatcgaataaaaacacggattgttttatattttttagtcggcaaaaccgtgagtcgaacatttttttttagttcaattgccataatgcacctcttatcctctcaaaaatcatctcttcaattatagcataatgcagaatttttccagaaaaattactcattttacgggcgtatatttttataaatcatcgtttattcgttatactaagaataaatttaaaggaggtttgtttatgatcaaggaatttaaagaatttattttgcgcggaaatgtgattgacttagctgttggggttgtcatcgggagtgccttcacagcgattgtcaccagtttggtagaaggtcttttaacaccattagtttcgctggtattttcatttttcggcagcgaagatgcattttcagggcttgtttgggagcctaaaaaaaatgtcgtctttaatttcggtcaagtgattactgcaattattacattcttgattactgcttttgttctattcttaatcgttaaagctgtgaataaattgcgcaatcttcatcaaaaaccagttgaagaagaagaaccagaagttactgccgaagactatcttcaagaaattcgtgacttattgaaagtacaaacagaatcccgtaccaatatcacaactaatgatataaaccgtgatccttttaactagatagttttttagaatgattcgaacaataatggatagctcttgaaatcagaaaagctctggcaaatacatgtcagagcagagagttattcatgatttgttcatctttttttttataagtaatgactgcttttatttctcttttctcataaccacatgtaaaattccatcttcatcaaaaggatcggaaacagtgacaaaattatatttcccgtaaaatttctgcaaatgcgcttgagcttcgatttcaatcggagcatttggatagaaacgatttagttgtttgatgatttcttgtagcaattgatccccatgcccttgtccacggaacagaggatttactaaaactcgaccaaaatgaaccgtaccttcgataaaatatatccttgcataagaaacaagttgttgctgttcatcaaaaatacaaagatgtttagcaatcaaatcaattgcatctacttcttgatagggacaattttgttctacgacaaacacttgagtacgtaaagcagcgatttggtgaaattctaatccggtcatctcatgcaactcttttatcataacaatcattctactatctcctaactaatcaataataaaaaatacaaaaaaagagctaacattttgtcagcccttttctgatcaaacagcttttgttaaaaattcaatctcaaccgttcgagtaagaatatccgaataactataggaaacacgttcgaacgaattttcgtttggatctaaatccacgacaaacacagaagggtatgtttctgtcaaaacaccacggcgttccgtttgacgtttacgcccagtttgagcaactagcatgatttcactgcctatacgaccttctaaatcttttttgattgttgctaaagttgttggcatcgcattcacctcaagcaacagtatactataatttacagaaaatttcaagtttaccataaaataattattctttcaataagattttctctaagggttcataagaagcgctctcaatttctttttaccgcggttgtaagcgattttaatttgttgcagtggaagttctgtttgttctgcgatttgttcaagttctaatcctttcaagtaattcattataacgatttgctctaacttcgaaaatggcgaatcgtatttattcatagtttcttgaagcattaaatacttctccgctttttcagtttgttcattttgatcggagagaaaatttggtccttcatgagaaattttttcttcaagagaagaagaatttaattgtgcttttcttttttgtgcttgttgcaaccgtaataaactgcagacgcgattttcaaacgagcgtttgaacaaaactcctagtgttgttccacggttttcatcataagcctgcagacatttgttaaaaacaatacggccttcttgcatccaatcatctaaatcataatctttgagataatattttttgtacataatctcgacgatagggcgatacttgaaaaacattgcttcaaattcttctgaactcctactgattgattcgtttgatttcattttgttacgctccttttatgcttaatttttggtacaaaaagagcgtaacatattcttgttcattagtttctcatttaacgaaccaactttgtccctaactcaaatcatgcagttttttttctaattcagctaattgttcaggcgtccaaggagagtttctgcgaaaattttcaaatttgatgtctgtttgatgctgatggattgcttcttctgttttttcaatacttttataaagctctcgagcagaagttcgcaacgcaccttgagaaaacacaacccattgttctgctaagtcactcgttgcaactgttacttgagtcaaacggtcattcaattctccagcgatgcgctcgatatagctgtcagcagtttcaccttcttcagtaaagatgacttgtaactgatatttactatagctttgagtaacaccgggaaccaattgcgcatcaaatacaacaataatctttaatccttcgtattttgaataattggataatcgatgcaataacgcctctcttgcatcttctaaacgatcttggttttttaataagactaattcaggccaagcaccaatcatattatagccatcgacgattagcaggggcgttttcattgcggcgccccatttcgactagtaaaagcttgatacattaataacccagctgccacactagcattcaaactttgtacatgaccagtcatcggaatagtcaacatctcatcaacatcttttttcaatccttcactcattcctcgaccttcattgccgataatcaatcccgctgccccttgagcattccacaaacggtaatcagttcctttcatatccgttccaaaaatccaaaaaccagcttgttttagttgttgaatcgcttggcttaaattggtgacacgagcaatcggaatatgttctacagcaccagtagaagtcttcacgactacaggagtgattcctactgcacggtgtttcggaataatgattccgtctaccccactagcatccgctgttctcaggattgaaccaaaattatgtggatcctctaaattgtctaaaatcaaatagaatgactgctcttttgtttgtgccaataattcatccagtgataggtattcataaggggtgatcgctaaaatcacactttgatggacgccttgattgctcatttgatcgagcttttgttttggcacccacttgactgggacagactgtgcgcgagcagcttcttttaacccatcgattttttcccctctggcatcctctgccataaataatttattcccgcgtccttctttcaacgcttcaattaccgcatgataaccgaatacaaaattctcatctatcaattcagttgtttcttcacgaaaattctttctagtgtgctgtttattttttaccgtgttttgacgcgacggttttctttgtttcttttccctcatcttcttcccctactttcttgatacaccaagctacgagcgtgtctaaacgatcctgttgctttgttaagtgtagatacccaattaaggattcaaagcctgtagcaatgcgataggtggttacatcagcattttttgcactggtatggcttttactatttcgtccacgacggtaaaaatcatattcttcttcagtcattatttcttcatcaagcatcttttggatcaatgccgcctgagcttttgctgatacatagtgtgtcgccatatgatgaagctgattaggtcttgtttgtccttgttcaatcaaatagtcccgaatgtatacttcatagaccgcgtccccaatataggctaacgctagtccgttcaactgtttgtaatctctcatgcgtctcttctccaccgggtaccttgcgctgtgtcttccaagataatccctttttcttttagcacatcccggatttcatcgcttcgggcaaaatctcttgcttgtcttgcttggatacgttcttcgattagttgttcgatctcttcatctaaaagttcctcacccacaaagtaaatcccaaagatggctagccattccttgaatttttcaactgcagcagtcaataattctatatcgattgaagcactttcactgtaagtgttcaaccattttgcaagttcatatactactgtgataccatttgctgcattaaaatcgtcatccatttcttgtacaaaacgctgttcaaattctgctaagatggcatggtcggttccttctgggaatccttctttactattttgcaaacgaaattgtgcattttctaaggctgttctcaatttttgcagatttgtttctgcctctttcaatgtcgtttcactgtatttgattggacgccgatattgggtagtagccaaaaagaagcgcaaaacttgaggatcaattttttgaaccatttcatggacagtaacgaaattgcccaaagatttactcattttttcttcttcttcaccaatcgtgacataaccattgtgcatccaataattagcaaacgtcttacccgttttcgcttcactctgtgcaatttcattttcatgatgagggaaagtcaggtcctgtccacctccatgaatatctattgtttctcctaaatgtttggttgccataacggagcactcgatgtgccaaccgggacgtcctagtccccatggtgaatcccaagcgatttcgttttccttagccgctttccacaaagcaaaatctaacggatcttctttgatcttttgttcttcacccgttcgttgactggccccaacttctaattcatcaattgattgatcacttaactgaccatagtgcttgaatttacgtgtacggtaatacacatcattatttgccatataggcgtatcctttatctactaatacttgaataaacgcaataatgtcttcgatgtgatccattactcgcggatttaatgtagctggttgaacatttaaagccgcagtatctttattgaatgcttcgataaaacgatctgctatttctggagcagaagttttcaattctttggcggtccgaataattttgtcgtcaacatcggtgaagttcattacgtaatcgacttcataccctctatattctaagtatctgcgaatcgtgtcaaaagatactacactacgtccgttgccgacgtggatataattgtaaactgttggcccgcaaacatacattttcaccctaccttgttcgagaggttggaaaacttcttttttacgtgttaacgtattataaattttgatcatcttggctaaccttctttcctttgattcttacgactttggctggtattcctacagcagtcgcttcatttgggatatcactaagaaccactgcactagcaccgattctggcgctttcccctattgtgacagggccaagaatttgtgcatgagctgaaatgaatgcccctttttttatggtcgggtggcgtttccctttttctttacctgtcccgcctagtgttacaccgtgaaataatacgacgtcatcttcaataatagctgtttctccaattacaacacccatcccgtgatcgataaaaaccccttcgccaatctgagcaccaggatgaatctcgatgcctgtcagaaaacgccaaaactgggatgtgagtctagctagaagaaagagttttttttgaaataaaaaatgcgaccagcgatgccaaaacaatgcgtgaaagcccggataagacaatacgatttccagcgttgatcgagctgaagggtcattttttttcgctgctgcaattgctttttgggtccaagtcatcttctcacctgcttcccctattgattacttacatacaaaaaagcatctttcaaataagtttccttattcaaaagacgctcaaccacgtggttccacttttgttcacagaattttctgccttggtgcaggtaacgtctgctgccgtttttgacttgcgccaaaaccactcctaggtgcatttccttactttttttaatcactctcaccacccgtgatctctcttcaaaaaaaaggtaagtacttcgtctattcttcgtgtttataatacattatttaaatgatcaagtgctttttcttttcctagtaattctactgtatccggtaattctggtccgtgcgtttgtcctgagacagcaacacgaattggcataaacaagtttttgcctttgattcctgtttctttttggatctctttgattgcagcttttactgttggtgcgtcaactgtagtcattgcagtcaatttttctttaaaggcattgagtacagttggaacagtttcacccgccaagacttcttgcgcagcagcatccaattcaggatgttcattaaagaataactcagaaacttccacaatttgtgcagcataactcatttgtggttgatatagtgagacgatttttttcagccattctcttttttctacggaaggctcttcttcaattcgacctgctttgattaaatatggcaaacacatttctgtcaactgatccaggtccatttgacgcatatagtggttgttgacccactccaattttttggcatcaaaagccgctggtgatttgctcaagcgttctggatcaaacatttggatcaattcagattgagaaaataactcatcttctcctactggggaccaacccaacaatgcgataaaattgaacattgcttctggtaagtatcctaattcacgatactgctcaataaattgtaaaattgattcatcgcgtttacttagctttttaccagtttcgctgttgatgatcagtgtcatgtgtccaaattgtggcgcttgccaaccaaatgcttcatagatcatcaattgttttggtgtattagcaatatggtcatcgccccgcaatacatgtgtgattttcatatgatgatcatcaactgccactgcaaagttatatgttggcatcccatcgcgcttttgaatgacaaaatcgccgcctacattatctgactcaaaaacgatctcaccttttaccatatcatgaaacttatactctgtatttctaggaactcggaaacgaataactggttggataccttgtgcttctttttccgcttgctcctctggtgttagattagcgcattttccgccataatgaggcatttcgccacgttcgcgttgttcttcacgctctgcttctagctcttcttctgtacaataacacttataggcacgattgcttgctagcaactgatcaatcaatggttggtacaactcaccgcgttctgattggcggtacggtccgtactctccagggtttgcaggggattcatcccaatcaatacccaaccaagcgagattctctagctggctcttctcaccatcttcaatgtttcttttttgatccgtatcctcaatacggataataaattcgccatcgttatgacgtgcaaataaatagttaaacaatgctgttcgggcatttccgatgtgtagatgtccagttggacttggagcataacgtactcgcactttagtcatctttttcctcttccttcatctgatttgcaaacaatcctttgctgttcggtttttaccttctagcttatagggaaaatctccgataataaaatagttcgctcagctagaattgtacaatcattaagcaaaatagtaaaggcaaccggcgtaaaatccgccaattgccattgattattgctaattttttgtgtcatcctgattatcgattccacgacttgaatgagccggtttagcaaatatcattcgtcccgcagctgtctgcagtgcgctcgtaacaactacttggatatgttcattcatgtaatgctgtccatcttcaacaacaaccatcgttccgtcatccaaataagcgacaccttgttgtctttccgttccagcttttacaacaagtacattcattgtttctccaggaatcactactggtttaactgcattcgcaagagcgttgatatttaacacaggaacattttgaaattctgaaactttgtttaaattatagtcatttgtaaccacaataccatcaaggatctttgctaatttgatcaatttgctgtcgacctcagaaatatcatcgaagtcaccctcatacatttcaacagcgataccttcttctttttgcaaagcattcaaaatatctaatccacgtcgacctcgtacacgtttcaagctgtctcctgaatctgcaatatattgtaattcatataaaacaaaattgggaattaataggaccccttcaagaaaacctgtcttagcaatgtcgtagatacgtccatcgatgataacactcgtatcgagaattttatacttatgaaaatgatcagctattttacgatcaagcatctgttgttcttcaacaggttctgttttcttgcttttagaagaaaagatttttttccattcttcgattcgagtcgtgccaatttgaaagccaagatatcccaacaacgccattactaaaataggcgcgattccgttaataaaaggaatatcccaattataaaaaggaatcgatacaatgaccccgatcattaaaccaataattgatccgattgctccaaataataaataagttagactcaattcactcaatttttcttcaattttacgaattccagctgcaatatatttcgctaatagcaaagataataaaaagaaaataagggctccaagcaagctattagtgatattattgttcagccattcattttttgattgaccaatggtttgccatgcaacaggcattaatgagatacctaaacttgctccagcaagaaccattagcgcagtaatgactcgtttctgcatacacgttcctccaaactaatttagtacgaagctgagactcataaacgaaaaaatcttttttagaaagagctggacaaagatagcaccttctgatgcaaatagttctcaataaacagtcttcattcattcttgttctgataatttcgttattttcgtctcatcttcgaatttattcttttttttttaactaacaccttatcagaattaacgaaaaacttttcgtagggtttccgataaagttgacacgccttctacttcgatacctttgggcggttgccacccagtaagattatttttaggtaaatatactttagtaaatcctaatttttgcacttcttttacccgttgttcgatcgcattgacgcgtcgaatctcaccagtcaacccaatttcaccgataaaacattccgtaggactcgtacctttttccttataacttgaggctatgctgactgcaattgctaaatcgattgcaggttcatttaattttacaccaccagctgcttttaaataagcatcttgattctgtagaagcaacccagcccgtttttcaaggaccgccatgattaatgaaacacgattaaaatccaatccggtagtcgttcgtttagcgttaccaaacatagttggtgtcaccaaagcttggatctctactaaaatcggtcgactgccttccattgcaacaacgatggcagaacccgtagcgccttctaatcgctcctcaagaaagacttgagaggggttggctacttctttcaatccgcctgcttccatttcaaaaatcccaatctcatttgtcgaaccaaatcgatttttgacggcacgcaaaatacggaagctgtgatgcttttcaccttcaaaatataaaacggtgtccaccatgtgctctagcattcgtggaccagcaattgaaccttctttggttacatgtcccacaataaaaatagcaatcccgttggttttagccagttttagaagttcggcagtcgtttctcgaacctgactcacgcttcctgccacactagtgatatctggttgtgtcatcgtttgtatcgaatctatgatgacataatccggtgttagattttcgattgccttgcttatctcagacatatccgtttctggatataaataaaattccgtatcaatggctcctaaacgctgggcacgcatttttatctgctctgcactttcctcacccgaaacatacaatactttgccgccaatagctgcaagctgctgtgagacttgcagtaaaagagtcgacttgccgattcctggatcaccaccaatcaaaatcaatgatcccggaacaacaccaccacccaaaactcggtttagctctgctagtttggtctgtactcgtggttctttctttggtatgacatcagcaatttttgttggttgcatccgttgtcccgtaagagtagtccgtactcgccgatccgttgtttcttgaatcacttcttctaccatcgaattccaactaccacaattagggcacttccctaaatactttggtgaagaatatccgcaattttggcagacaaactgactctttgctttcttagccattgcaaacctccaattcgttatctaggactgactgcatgcgtatatcgaacaatcacagatctgaggaaccaaatcctccagagcgtgattgactggttacatcttgatccgcttttaaaaacggcaagaagatcccttgaccaattcgttcaccttttttgatggtcaaatcactgggaccaaaattcgtaaattgaaacatgatatgcccttcattatcagaattattgtaataatcactgtcaatgactccgacaccatttgttagtaacaaaaaacgtttgagaggattgctcgaacgattcgttaattgtaaatactcttcttttcccatatatgatttgattccagtcggaaccagtgtcggtttgattgctttttgaacatctttagctgtcaacgcttggatgccattcatcaaccccgctttccatatactaggtattacgacttcttctgccgcttcaaaatcataccctgccgcatggtgtgttgcgcgttgcggaagagctatatccttatctgcatatgttgaaacaatttcaaatccacgtgtcttcatcttttcctccaattaataaacatatagtcattttagcatagtaacccttgttttctttaatgaaaacaaaattaacagaaactctttatattttcttcgcttccgcagtcaaaaaaacgaagaaaatagaaaaaggacatgacgaaaggctattttgctagtacaatagaaaaaatattatttactgaattcagaagaggtggttacatccatgcgagagaaactaaaaaaagcgaatcgagtcgttatcaaaattgggaccagttccctcgtctatcccaatggaaatatcaacttctcgagtattgatgaactggcttttgttctgtccgatctaaagaatcaaaacaaagagattattctcgtttcttctggtgctattggtgtagggatgaataaactaaacattccacaacgtcctgtagaaatcccccagcaacaagctgttgcagccgtggggcaagccgaattaatgaatatttacaatcaccgttttcaagtttacaatcaaaaaactgctcaattattgttgactcgagatattattgagtttcctcaaagtcgagaaaatgtatgtaatacattggagcagctcttagcgatgggaattatcccaataatcaacgagaatgatacagttgccatagatgagttggaccatcttactaaatttggtgataatgatcaattatctgcaattgtagcgcagttagtccatgcggatctgctgattatgctatccgacatcgatgggttttatactgctaatccgctacatcataaaactgctaaactttatgatgaaattactgagattacacctgatttaatgaaacaagctaccggaaaaggaagtccgtatggaactggtggcatgtcaagcaaattaaaagctgcggatcgtattctcaaaacagatgccacaatgatcttggcgaatgggaaacagcctaaaatcatttttgatatcttagctggcaaaaaggttggcacttacttttacaaggaggaaacattatgatcgatttaatgcaattgggaaagcaagcaaaaaagagtgcggcctcacttagcttactaaccgctactgagaaaaatcacttactatcagctatggccgatacacttgaaagaaatcgttcacgaattttaacagaaaataaaaaagaccttgctgctgcaaaaaaaaatgcattaaattcaactttaattgatcgcctagaattaactgatgaacgaatcaaggagatggcaactggtattcgaaaaatcgttcagctccctgatccacttggaatcgtggacaaaatgtggcgcaatagtgataatctcttaattggtaaacaacgtgtaccattaggtgttgtgggaattatttatgaagcaagacccaatgttacaacagatgctgccggtctatgtttcaaatctgggaatgctgtcattttgcgaggaggtaaagaagccttctactcaaatcaaatccttgtaaatcttttgcaagaaacattaagcgccaatggatattcaccctattctattcaatttgttgatgacaccagtcatgcagtggctgatcaaatgatgcgcttgaacaagtacttggatgtactgattccacgaggcggtgctaacctcattcgtcgtgtcaaagaaacagcaacagttcctgtcattgaaacaggaacaggtaacaaccatatctttattgacaaagatgcacagcttccgatggctgtcgacattgttgtcaatgccaaaactcagcgaccttctgtttgcaatgcaatcgaaacgatcctcgttcataaaagttgtgcagcagactttctacctttactagaaaaagaactgaaaaataaagtagagttgcgtgctgatactaacgcgcgaaactatttaataaatgcgcaacctgctactgaagaagattggcaaaccgaatttctagattatattgtagccatcaaagttgtagattccatcgatgaagcaattgcccacatcaatcattacaacactaagcattctgaagctatcgtcacggataactactttgcctctcagaaattcttacaagaagtagatgctgctgcagtatatgtcaatgcatctacacgattcacggatgggtttgtttttggttttggagcagaaatcggcatttcaactcagaaattgcatgctagaggcccaatgggactcgaagctctgacttccaccaaatatattatctatggagaaggtcaaatacgtaaataaaaaagctgcttgattccggagacttcaatctttaagtgattttcacttttgattgaaagtttctttttcaagctgcttttctgattgattatgcttgttcaattacaaattcaactggttccatagcgaagagttgctgtaaaactgcatttgcttctgtaaacaattcctgatcacaggcttttttctgacaaacaattctttgttcttttgaaacaaatacttgtgtagcatcattatccacaaatttcacttcttgattctcttttcgaaaaatgtagccctcttcttcgtctaataatagcgctgtctgccaatgctcattttggataagtggcattactaaagatgctacgtccagattttctacagaaacttctttaccattctctaagtgcatcgtaaacgtttctaactcaaaggcctggcaagcattgcaccctccttccgtaataaaatgtttacttttgataattgctttcatgttctcacctgcttttttttaccagtttacctcactaacatctctttgactaccgacggagaaaaaattccgccttaagatggatgttccacctcttctttcttgataaaataaatttaagaaaaaggtataggaggatttattatgaatacacaaagtttgttaggtaaaatcgtaactgttgtagcagttttagttctggcttcattgctcttatctctcgtcttaggattaattggcggattgattggcggattgattggtttaatttttcgttttggtattcctttattgttagctgttctaattgttcggtggctgacaaacgttcgacaacgaccaaaaaaatactataactaacaaaaagacttggagcattatctgttccaagtcttttttgattatcctaaagcaacatccaaaaccatcatcagaatgaagcctgtcataacaccaaaaactgcaaaatgccgtcgactactagctgtttgttgtgcttcaggtattagttcctctaccactacataaatcatcgctcccgctgcaaatgctaaagcatatggcaaaacggctgtcatacttgttaccagcaaagcgcctataacaccggcaatcggttcaacgatcccagaagcttgtccatagacaaaggccttattacgactcaatccttcctgtcttaaaggaatggatacagcagctccttcgggaaaattttggatcccaatacctatagctactgaaatagctgccaaaactgctgcccgaggatcttccgagctggcggctgctccaaaagccacaccaactgccaagccttcaggaatattgtgtaatgtgatggagaagaccaacagaatcgttcgttttaaatggcttggaaagccttctgtttcatggttaggaccaaagtgcatatgcggtaatgttttgtctgcagcatataaaaatagtccacccaatccaaaaccaatactaaccacaagccatgggatatccccattttcttccgcacgagcgatagcagggtctagtaatgaccaaaaactcgcagcaatcattacaccggaagcgaatcccaacatcgtattcagaacatttttattgatatccttaaaaaaataaacaagtgccgcacctagagcagtcatggcgtatgtaaataaagtaccagccaaagcctggtgccacggggacagttgcattaaccattcaaccaaaacatttctctcctcctatcttctccctttactctagcataggaaaacgcttgattctagccttttgttttactcaaaataattctaagctccttgtttgattgtagggaaatccttgagtttacttgaaactttcaacattcatcgctataatgctaggagactcaatgtcaatatatataaagtgaggaaaagaattgattacagtaagtgatgtaagtttgcatttttcagatcgcaaactgttcgacgatgttaatattaagtttacgcctggcaattgctatggtttgattggtgcaaatggtgctggtaaatcaactttcttaaaaatattatctggagaaatccaaccatctacaggaaatgtttcattaggacccgatgaacgaatggctgttttgaaacaaaatcattttgacttcgaagaatacccagttattgaaactgttatcatgggtcacaaacgattatacgacgtaatgaaagaaaaagatgcgatctacatgaaagaagactttagtgacgaagatggtatccgtgctgctgaactagaaggagagtttgctgaactggatggttgggaagctgaacctgaagccgcagttctcttacaagggttgaatatccctgatgaattacaccatgtccaaatgaaagaattaacagctggtcaacgtgtgaaagtgttgttagcacaagctcttttcggaaaaccagacgtcttgctcttggatgagccgactaatggattggatatccaatctattaactggttagaagaatttttaatcaactttgataataccgttatcgtagtttcccatgaccgtcacttcttaaataaagtatgtacccatatggcagatctagattttgggaagatcaaactgtatgtcggaaactatgatttttggttagaatcaagtcaattagcagcaaaattgcaatcacaatcaaatgcgaaaaaagaagaacaaatcaaagaactgcaagaatttattgcccgctttagtgcaaacgcgtcaaaatcaaagcaagccacttctcgaaagaaaatgttggataaaatcacacttgatgatattcaaccttcttcacgccgctatccttttgtaggatttaaaccagaacgggaaattgggaatgacttgttgcaagtagataatgtcagtgtgactattgacggtaaaaagattttagataatatctcattcactttgaataaagatgacaaagttgcttttattgccaacaacgacatcacaacgactacattattcaaagttattatgggcgagatcgtgccagatactggtagtgtacgctggggtgttacaacacaacacgcttacttgccaaaagatactactggtgaatttgatacggatacaccaattgttgattggttgcgtcagtatgctagtaaagaagaggatgataatacattcttacgtagtttcttaggtcggatgctgttttcaggtgatgaagtcttaaaaccagtcaatgttctatcgggtggcgaaaaagttcgttgtatgttatcaaaactaatgctatcaaaagctaatgttcttgtcttagacgatccaacaaatcacttagatttagaatcgattactgcattgaatgatggccttatggcttttaccggctctttactttttgcctctcatgaccatcaatttattcaaacgctcgcaaatcgaattatcgccgtttcaaataaaggtgttgttgatcgtgcagagactacctatgatgagttcttagacaacaaagatgtacaacaaagaattcaagaattatataattgatctccaaatgaaaaagccaaatgcaagaactcttgcatttggcttttatatttaagagaaaatcaatcactgatcaaacgtgtttttccgaatgaaaaaagtgccaaacaaccatatcctgtatggctggcaattgttggtcctaaaggataatgataaataattaatgctggaaattgctctttcaagagtcttaacactttttctgctgcttcgtcatcacctgcatttgcaagataaaccgtctctatttgagattcacgcagattcgctactgttttatcaacaattttttgaattgatttatttcgacctctcactttatcgacatttttcaactttccatctgtatctacagtaataattggtttaacatttaataggccgccaatggccgctgctgttttagatattctaccgcctctttcaagatgtcgaagatcatcaactgtcacccaagaatctagagataatttatgttcttctacccactggctgacctcatgaagagaccaaccttcactttgtctttttgctgcttccgctactaaaaaaccctctcccaaactagcagattttgtatcaatgagtgtgatttcagcatgagggtattcttctttaagaatagcaacagcttgaacagcgctttgaaaagaaccgctcattccagacgaaaaacctagataaagtatcggtgtgtgcgattctacatatggacgaaaaaattcaacataacgtccgacgttgatttgagaagttgtcggttgtgcattttcttttaatttttctaaaaaccacttggcatcaaattgttcacccatatcatcgatatattcttttccttcaagttcaattgtcatagatatatattgaacacccaattcagctaatctttttgctggtagatcacaacatgaatctgtaatgatttgatacataggtacaccccctttgataaccttattatagcaaaaaaagaacaaggcagaagaaatcatacttgaagacgggaaaatcatcgattttcttctaaaatactctgccttgttctttctactattcaattctactaattaattctacccactgattagatttgtgcccaaacactctctaatatattcgtttgattacgatctggccctactgaaaatgttgagatacgaaccccaactaattcagagatacgatgtacatagttacgtgcattttcaggaagatcagctaatgttttgcatccagtaatatcttctgaccagcctggtaactcttcatagactggtttacaacgattcaattcttttagacttgcaggataatgataaatcaattctccatctaattcataagcagtacaaatttttacagtttccaagccgctcaaaacatcaattgaatttagagacagattcgtgataccagaaacacgttttgaatgacgcatgacaacagagtcaaaccaaccaacacgacgtggacgaccagttgtcgtaccatattcacggccaacttcacgaatttgattgcctgtttcatcaaaaagttctgttgggaatgggccatcaccaactcttgaagtatatgctttacaaacaccaactactttattgattttagaaggacccactccactaccaatagttactccaccagctactggatttgaggatgttacgaacggatatgttccttgatcaatatctagcataactccttgagcaccttcaaacagtacgcgttttccttgatctagcgcatcgtttagaataactgaagtatccgttacatatttcttgatttgttgaccatattcataatactcttcaaaaatatcttcaaaagcaatcggctcatcatcaaacattttaacaaattgacgatttttttcttcaagattgatacgtaatctttcttcaaaaatttctttatcaagaagatcagcaattcgaatacctacacgagcggctttatccatataagctggaccaatccctttgatcgttgttccgattttattgtcacctttagcatcttcttgtaactgatctaatttgatatgatacggtaaaataacatgggcacggtcagaaattttcaaattatctgttattatattattctcttttagataggcaagttccttaacaagagattttggattcacaactacgccatttccgatcacgctaattttatctttataaaaaataccggatggaatcaagtgtaatttatatgtcactccatcaaacttaatagtatgtcctgcattgtctccaccttgataacgtgcaatcacttccgcattttcactcaaaaagtcggtaatcttcccttttccttcatcgccccattgggtacctactactactacagatgacatttaatgacctctttctttatatattgcactccataagtattgtaccagtattcgatcatggattcaatctaaaatcgaatgattgaattcattaaaatgaaaaaaagcagaaaaaaacgaactatattttatttattttttttatacaaagctaaatacgaataaaaaaaagcaaccggcaatagtaccagtcgcaacctatcctatgcaaactcaactcttggagatagagaggaaaacttattgtattccttgataaacaataattcaactgttccccgtgctccacttctgttcttttcaataatcacttcaatgacattattgttttgcggctcttcaccgccatcctcttcgtcaccttcacgttgatagtaatcgtctcgatagagaaatgcaacaatgtctgcatcttgctcaatagatcctgattcacgaatatcacttaaaactggacgtttatcttggcgttgttccacccctcgtgataattgagaaagcgcaataactggaacttttaattctttggctaatttcttcaattgccgagaaatctcagagacctcttgttgacggttttctcttcctgtaccttcaatcaattgcaaataatcaatcaatatcaaacccaaattccctttttcctgtgctaatttacgacaacgtgctcgaatctcggaaattttgattccaggtgtatcatcaatataaatactagcattcgacaaacttcccatggccacgatcaaattgcgccactcttcttctgacagttgaccggtccgtaaatggctggcttcaatagatccttccgcacatagcattcgattgactaatgattctgcacccatctctaagctgaagatggcgacagaacgatctgtttttgttcctacattttgtgctatatttagtgcaaaagctgttttaccaacagcaggacgtgctgctaaaataattagctcttctttttgaagtccagctgtcattttatctaaagctgcatagccagtaggcaatccggtaatttcttcgttattttgcgctaactgatcaatattttcaattgttcgatttaacacatcagcaatagactgaaatccgttgctatttcttttttctgaaacctctaaaatgcttttctctgcttgatcgacaatcgattgaacatcttcatcttgttcaaacccctttgtcacgatacgactagcggtttgaatcaagttgcgtaaagtcgctttgtcgtccacgatttttgcataataagcaatactagcggccgaaggagaagcttggctaagttctgttaaataagtaagcccgccgatatcttccagactattacttttttctatttctgctttcaatgtgattaggtcgatggattcattacgatcattgagttgaatcatcgcttgaaagataatctgatggctgcgccgataaaaatcttgtggttcaataatttccatcgcatcaataattgaatccgcgtctaaaaagattgctcctaaaaccgcttgctcagcttcaatgtcttgaggcggaatttgattttgccatacttcattcatgactttcgctcctaatctagtgttcatttattctacaggatatcaaatcaaagcacaagagaacctcgattacaaaaatatccgcttaaaaaaacccaacattttactgttgggaaactttttattcttgtaccgtttggacggtaattgtagcagttactttagaatgtaatttgacgggcacctttgtataacctaatgcccgaatgggttgttctaactcaattttccgcttgtccaattttatactatattgtttgttcaaagcatcagcaatttgttttgatggaatagaaccaaacaatcgaccatcttctcctgctttcgctttaattctaacaactgtttcttccttttcaaggactgtttttagttcttcagcctccgccagtaattccgcttcatgtttttcttgtgctttttgttttccttttaattcggccatgctttcattattagctggtttagctaagttgtttttaattaagaagttttgtgcatacccatttggtacatccttaatatctcctttttttccttttcctttaacatcttgcaagaaaataactttcatctgtggtcactcctcattctctttctaacttgttaagttcttgaattaacatttttttgacttcatccaagcttttatccttgatttgagtagctgcatttgtgaagtggcctcctccaccaagtgcttccattaaaacttgcacgttgattttgccagtgcttcgagcactaataccgatcaacttactaggctgccttgtgatcacaaaagcagcatgaatcccattgattgataaaagcgtatccgctgccttagcgactgtcacactgtcatatactcgtttatcatcagctactgcgataacgatatcttctttgtaatgtttgcttttagaaactagttcactaatcattaaataggagtctaaatccgtactaagcatatattgaacaagtgaagtatccgcaccatgatttttgaggtatccagctatatcaaaagttctaccagttgttcgaacagagaaattctttgtatcgacataaattcccgccaataaagaagtagtgataaatttgggaatttgtgttttgcgagtagaacgatattgtatcaactcagcgactaactctgatgccgaagatgctgttgattcaatataagtcaacaacggcttatctggaaactcatctccgcgacggtgatgatcaattacagcaattttatcaaatacatcataaactttttgtgagattgacatagacggtttatgataatcaaccattactaagacactttcctcattggataaagttacagcttcctcacctgaaataacaattcgttctaaatcaggatatttcttcaattcttctaatacccgttcaatatccgcagtaatttctttaggatttaaaatgatgtaacattcacgttcactcatcattgccatataagcaactccaaaggctgcacctaaagcatccatatcagggtacctgtgtcccatgataaatacctttttattatcagcaaatattttttttaatgtagtactcatagcccgagagcgaacacgagttctcttgggcgtaccatctgtattccccccaaaaaactgtggttttgcttcctcatcagctttcttcagtaccacttgatccccaccacgtaccaaggcgatatctaaattattttgagctacttcgcctattgtctctagcgattcttctccgtaagagattcccatactaatggttaaggctaagtcattcttttcagcaatattacgaacacgtgtcaaaaattcaaaattcccttttttcatcttctcaatatcttcaatcttggcaacaaaaagaaagcgttcagaattaatccgcttataaaagatatgattttcactggcccaatctgaaatcagcgtcgtgatcaaagagttcaagtaggatatttgtttgtcatcttttttgtcaattagatcatcatagttatcaattgaaataagtccgattgctgacataatttaactcctcaataaactgctatagaaatattaaacacttttatattttaccacatcttatacgaataagcgatttcctaaataaagtttcacgtgaaactttatttaggaaaccacaaatcaaataccggcaaagattttttcgttatttaaagattgaattaaataacaaatacactaaatgtttttagtaatagtatatacaaaaaaagttgacaactgtcaaaaacagttgtcaacttttgaatagtaaaaattattcttcgcctacaaatggaagtaatcccatgatacgtgcgcgtttaattgcaacagttagtttacgttggtttttagcccctgtacctgttacacgacgtggcaaaatttttccacgttcagaaatgaaacgttttaacaattctgtatctttataatcgatgtgttcgatatgatttgcagcaatatagtctactttgcgacgtttacgtccgcctcttctttgttgtgccattctatttccctcctatcaatttattagaatggtaaatcatcgtctgaaatgtcaattgacgagtttccgaatggatcagaattatctcgatcaaagttaggcattcctgatggttgagaggattgattttgatttgtgctattgtttccgaatccagaagaaccactagtattatacgaagtatttccaccgctttcggtagtgcgtcgttgttcagaagcatttcgagattctaacaattgaaaattgtctgctacaacttcagttacatatacacgttgtccttgttgattgtcataagaacgtgtttggattcttccagtcacaccaagtaatgtacccttacgagcataattagccagtgtttctgcaggttttctccaaatcacacaattgatgaaatcagcttcacgttctccactttggtttgtaaaattacgatttacagccaatgtaaaagacgcgacgccagtgccgttagcagtgtatcgtaaatcaggatctttggttaatcttcctactaatacaacattattaatcaaagttcatcatctcctcatcgctttgtttcatgtgaaacaattttattcttcttctttgacaatcatgtgacggataatatcgtcattgattttagcaagacggtcaaattcattgattgcacttgcatttgatggagaagaaactttaacgatgtgatagataccctcacggaatccatccatttcatacgctagacggcgtttttgccaatctttagactcgataacttcagctccgttatctgtcaagatcgtgtcaaaacgtgcgatcaatgcagattttgcttcttcatcaatgtttggacgaatgatgtataagatctcatacttcgtattttccattgattattcacctccctgtggtcttaggcccctagtatattctaggagcagagagagtcgcctgattagactactcacaaataccaattatacatttttttcatccataatacaagattaattttttgacttttgacagtaaaattgcttgcatcaataagtacgcacaaaatattttcatttattaaaaaaactccaacaacatcgtgttggagttacattactattcatcattctgactttcagaagatatttcttcttctgtttcagaaacttccggatctacagtggccatcgtgactactttcgctccgttttccatcttcattaagcgaacgcctaaagttgcacgtccagtttgagatactgtttcagcgttaaatcggataatgacacctttgtctgtaattagcatgatatcttctttgcctgaaactgtagtcaatccagctaacggtccatttttcgcagtaatattcgcagtttttattcctttaccaccacgcccttttattgggtattctgaaccttttgtacgttttccgtagccattctctgtgataactaatacttcactatcttctttgatcacagaagcgccgacaacatagtcatcttctcttaaacggatgcctcgaacgcctgcagcagttcgtcccatatctcgaaccagctcttctttaaatgtaactgaatagccattgtgtgtaccaataatcatcacatcttgcccattggtttctactacattaactaattcatcattttcgcgtaacccaatagcaatcaatccattggcccgaatattggagaaagcagtaactgatgtacgttttactatacctagccgtgtcgtgaagaacagataacgtccttcttgaggtcctccagaagcagagataatcgcttcgatgcgttcgtttgaatcaatacctaaaagattgatcacaggaatacctttagcagctcgtccgtattcaggaatttcgtatcctttagctttataaactttccccatgttagtaaagaaaagtaaagtatcatgagttgaacaagaaatcaacgttttaacaaagtcttcatcgtgaatccccatgccttgaacaccacgacctccacgacgttgagcccgaaattcagaatttgctactcgtttgatatacccattatttgtcagcgtaatgacaatttcttcttcttcaatcaaatcttcatcttcaagactcaatacttctccaacaagtaattctgttcggcgctcatcaccaaagcgttgacctaattcttgcaattctgtttggataatttctaaaactcgctgaggattagctaaaatatcttttaagtcagcaatcaattccaacaaactttgatattcattttcaatcttgtctctttctaatcctgttaaacgacgcaaacgcatatctagaatcgcttgcgcttgtcgatctgatagactgaaacgttccatcattgtgttttttgcttcatcatctgaattagatgctctaatcaatgcaatgatttcatcaatatgatcaagagcaatccgtaatccttccaagatgtgagcacgtgcttctgctttgtttttgtcaaattgagtacgacgcgttactacctcttgttgatgctcgatataattttctaaaattcgtttcaaacttaaaatttttggtacgcctttttcaatcgccagcatattaaagccaaaagatgattgaagagccgtcattttataaaggttgttcaaaataactgaagcactaacgtcacgacgaacatcgatcacaatacgcataccttctcgagaagattcatcgcgcaagtccgtaataccttcgattcgtttgtctcgatgaagttctgaaatccgctcaattaattttgctttattgaccatgtacggcaattcggtgactagaattctttctttaccattaggcatctcagtaacttcaacttttcctcgtaccgtaatggaccctttacctgtctcataggcccgtcgaatacctgatttacccataactaggccgcccgttggaaaatcaggtccgggcaaaacttccatcaattcattcgttgttacttcaggattttccattagcagctcaatagccgcaattacttcattcaaattatgtggtggaatgttcgttgccatacctaccgcaatacctgttgtaccattgactaagagattaggaaaacgagcaggcaatactgcaggttctctttcagtatcgtcgtaattactttgaaaatcgacggtatctttattaatgtctcttagcatttccattgctaatttgctcatgcgggcttcagtataccgcatcgcggcagcaccatcaccatcgactgaaccaaagttaccatgaccatccactaacatataacgataactaaacggttgcgccatccgcaccattgattcgtaaatcgcactatcaccatgagggtgatatttacccattacatcaccgacgatacgggctgattttttatgaggtttgtctggtgtaacccctaattcattcattccatataaaattctacgatgaactggttttagtccatctcgaacatctggcaaggcccttgcaacaataacactcatcgcataatcgataaaggactcacgcatttcacttgtcagattgacatcatgaatattttgttttgcttcactcaagctatttcctcctttacgattggctagatatcaagatttttaacataatgtgcattctcttcaataaaggcacgccttggttctacacgatcgcccattagcatttcaaaaatttgatctgcttcaattgcatcgtctacacttacacggagcatcatccggttttccggatccattgttgtttcccaaagctgatggtcatccatctcacctaaacctttgtatcgttgaacacttggtttaggcgttgcaggcaatgactcgattgtattcttcaaatcttgttctgcgtttttgcctggttggatataatggatattttttccttgttttaccccataaagtggtggttgagcaatataaacatacccagcttcaacaattggtcgcatatagcgatagaataaagttaatagcaatgttcggatatgtgcgccatcgacgtcggcatcagtcataattactaatttatgataacgtgccttagaaacatcaaagtctgctccaaatcctgtgcccatcgctgtaaatagtgaacggatttcttcatttgccaaaattttatccatgcttgctttttcgacatttaaaattttccctcgaataggcagaatcgcttggaattcacgacttcgtccttgtttagctgatcctccagctgagtctccttcgacaataaataattcgcatttctcaggatcattacttgaacaatctgctagcttacctggcagattactaatttcaagagcacctttacgtcgagtcatctcacgcgcacgcttagctgcttgacgtgctttagaggctagcagtcctttttcaactacttggcgcccaactgctggattctccatcaaaaattttgtgaaatgctctgaaaataaacgatcagttacagtccgcacttctgagttccctaattttgtttttgtttgtccttcaaactgaggatctggatgtttgatggaaataaccgctgtaagaccttctcgaacatcttcacctgttagattctcatcattttctttcattagcttagacttacgtgcatagtcattgataacccgagtcaaagctgtcttgaatccagactcatgggtaccaccttcatacgtatgaatattattagcaaaacttagcaaattgttatgatagctatctgtgtattgtagagaaacttcaaccgtgatgccctgttgttccccttcaagatagattggttcaggaaaaataactgtcttacttgcatttaagtgttcaacgtagcttttaattccgccgtcataatgatattccttcagaacaggatgttcttctcgtttatcttcaattgaaatttttaagccgcgattcagaaaagctaattctcgaacacgtgtagccaacttatcaaagttaaaaacagtagtttctgtaaatatttcaggatccggtacaaagtgaacagtagtcccatgacgatctgtttcgtcaatcacttttagatcttcgacaacagctccccgatggtattcttgataataaactttgccttctttgtatactttaacatctaatgtggtagataatgcgtttaccactgaagaacctacaccatgcaaaccccctgaaactttatatccgccaccgccaaattttccacctgcatgaagaatagtaaatacagtttcaacagcaggtctgccagtctttgcttgaatatctacaggaattccccgaccgtcatcgacaacagtaatactattatcttcttcgataattacttgaattgctgtagcaaaaccagcaagtgcttcatcaatcgaattatctacgatttcccacacaaggtgatggagcccttctgaactggtcgatccgatatacattcctggacgcttgcgtaccgcttctaaaccttctaagacttgaatctgactggcgtcatattctttggcacgttcaactaaacttttttcttcttctgtcattcagtctattctccttttatgtgtcctttgtctacgtaaaaaatctctgcttcaacagacattttatcttttacatgttcaagtgtggttgtggtaataaatgtttgtacttttccttcaattgtttctagtaagtgtaactgacgagaatcgtctaattcactcatgacatcatctaacaaaagaatcggatattctcccgtttcttctttcatcaaatcaatctctgccaattttacacttaatgcagtggttcgctgttgaccttgggatccgaatgtttgaacattcctatcattgattaaaaagttgagatcatctcggtgtggacccactagagaaatctgtctcattttttcacgtgttttcacttgatccagtgcatctttgaattgttgttgaacttgttctagagatgcacttacagtaccaacactagacaagtattctatttgtaaaacttctttttcatcacttattttttgatggagttgattggcccaaaatgctaatcgttttacaaaacgttgtcgtgcaaaaatgatcttgctgccaaattcaatcaattgttcagtcaacacagtgagatagagctcatcattttgctttttttcaaataattgcttcaaatactgatttcgctgtttcaaaacactttgatattgcacaagatcatacaaataaatcggatcaatctgtccaatttccatatcgataaattttcttcttacttgaggacttcctttaacaagtgaaagatcttcgggggcaaaaagaattacattcaattgccctatgtaactactaagttttttttgctcaatatgattgactttcgttttacgaccttttttagttaaaaataattctaatggtatggtagaatgccctcgagacacagctccgctaacttgagccccagctgtatcccaacgaatcaactcttgttcacttgtagttcgatgactttttgtcatcgctaaaacataaatactttctaaaacgttggtttttccttgagcattctcgcctaaaaaaatgacaagatttttatcgaaagataattccaaagattcatagttgcgataattatttagctgaagattattcagacgcatctgaggcttccttctttaccataaaaaaagtaccctcatcaggtatctcaatcctcattcccgcatataatttgcggcctcgtctattctctggctctccgtctacaagtaccgtatgttcagctaggaaccattttgcttgtcctccactgctgattacgctgacttctttcaacatttgtcctaacgtcatatattcagtttctaaaggtatttgcattttcatattatccctcgattctatagaagaacgtataccattattatactcttttttaaggaataaaacaaatttatccgtataattttcattctgagaagttttgattgttttagataaaaaataagcaaaaacaaaaagaagggcttaaaatcgattttaagcccttctaaactatttttgtattttcagacgtttgtttcatgcatttacaataaatatgaaaaattctaatttgtgcggactggtgtaatcaattgaataaagcttccttgactttcagttggttccaaagtgaatggtctgatagcagaaataaagcgaatcgtgatgtttgtatctccaaaagctcttagagccgccttcatgtaatcaggattgaaagagatttccaatggttctcctgaaacttgctcgtaggatagatcttcttctactttaccaatctcaggagaattcccatataaaataacagaattttcatttattgacaaacgaacaatgttatttcttccttcatgtgaaagtaaagatgcgcgttcgatggctgacaacaattctggaactgaaaattcaatttctgtgttaaaacttgatggtatcaatcgatttgtatctgggtaagtcccttctaataggcgtgaatagaacttcattgtattggtttggaacaatacttgattatccatgatactgatttgaatagcttcttcttcatctgttaaagaacgggacaattcagtcaaacttttcccaggaataacgatgttgaaattcgcttccccactttctaatggaattactcgttgacttaatcgatgggaatctgtagctacagctaataatttcttattttcaagaacaaaatgaacaccggttagaattggacgactttcgtgctgtgaaacagcaaaaactgtttcgttaacaattttatttagaatgtgagcaggaacttcgatgcgatcttgactttcgacaactggtaaatgtggataactatcagcatctaatccatttacagtaaagttagctttccctgaagttattgctacttggttattttctatcacttccagcgtaacagtattatccggtaagcgacgaatgatttcactaaaaaatcgtgcttgtaaaataattgctcctgtttgttcaattttcatttgaactttttctttctctacgcttaaaaaagtctcaattgaaatatcagcattacttcctgtcagagttaaacctttatcagttagaactaatttaacacctgtaaggatcggtatggtagtttttgatgaaatggcacgttgaacggtttgtaattcttgcatgaactctgttcgatttaaagttactttcattaggagcactccttttatttatagttattaaataaggtaatagtagtaataggcttgttagtattgtggataactagaaaatatcattgagacgtcaacgaaaacgcctgtgtataacctgtgcataactttttgacatgtttttgctttatccacaactcaactaaagagaatgtttttgatttctgaaatttcattcttaatggtaggatccgtttctgaaagatgttggattttttcatgagcatgaatgactgtagtatgatctttacctccgaattcagctccaattttaggtaaagagttatccgttagttcacgagaaagaaacatggcgatttgccgaggtacgacaattcctttgacacgtttttttcctttgagatcatttatatggatatggtagtattttgcaacttcctcttggatttgcaatatagaaacttgagtgcttccatgacttgactttaatgctttgattgcttctgcagctaagcttgttgtaatatccgaattttgcatagttgcaaatgcttgtacacgcactaatgcgccttctaattcccgaatattcgaatcaatttgtcctgcgatataactcagtgtatcgtcagggatttcgaggcgttcagcttctgctttttttcttaaaatcgctgttctagtttctagatctggaggtgtaatatctacagataacccccatgcgaaacgtgaaaccaatcgttcaggtaacgtgggtatttcatttggtaagcgatcacttgtcaaaacgatctgcttgttatttcgataaagctcttcaaatgtattaaagaattcttcttgtgtcccttctttattgaccaaaaactgaatatcatcaacaagtaagagatcaacatttcggtattcattccgaaaatcttccattttattcttttggatcgaagtaataaaatcattagtgaagttctcactgctcacatatttgatttttgcatttggtctttttaacagcatttgatgtccgatagcatgcatcaagtgagtttttcctagacccacaccaccatagaagaataacggattatagatagaaccgggatcttcagctacaactaaagctgcagcatgagccatctgatttcctttacctataacaaatgtatcaaaagtatatttttcgtttagaatagtttttccttttttttctgctttttcagtaactgtttgttcaacagaaggcgatttttgcagagcttctgcttcttcagcagtgacaaaactaggaattagttcttcaccggtcttcatgaagcccatctcaacaatttttgcagctagatttttttcccaataagatttatgaagatcactgggtacttcaatcaataactgatttttttcaaaagataatatgttggctgtttcgatccaagcactgtaacttgctggattaagttcttctttaaaagatttctgaagatctcgccaaatggaatcagcagatgacataaattgtcctcctatagctaagaatagataatactaatttagcacggatggaagaagttttccacagattataataaaaaaggttagaaaaaaatacttttccacatctatggaaaaaagaacaggagaaattaacttatcaaatttacggttatccacagaggaggagtgtttgtggattgttacaataatctcttgtttatccacaagtaactgttaatcaaatacgttgatgtaaaagcattttactgatttatgcacagctagaaaagtgtatgtggataactttttagaagggtgtttatttgtggaaaaagcaggaaaaacttgtggaaataagttatccacaaaaatgcaaaatccacaagtaacacacagttcatttagtttatgtggaaaacaagacagtaaagtgggtgaattttatattgacaaaacactgtctgactcgttatactatcaaagtatgtctatgcgcataatcattattttgatggaggtgtcactaaatgaaaagaacttatcaaccaaataaacgtaaacgtcaaaaagttcacggattccgtaaacgtatgagtacaaaaaatggacgtcgtgttttagcaagtcgtcgtcgtaaaggcagaaaggttatttctgcataagccactgaatgccagtggttttttttatgccgttttttaaggaatatagtgaatcccttttactaaatatggtattattgacaggtgagtaaccaaagtagaaagaaatgaaggaaccaagatgagaaaggcatatcgcgtaaaaacagaacaagactttcaaaaggtttttcagaaaggaaagtcttttgcaaaccgtaaatttgttgtctatgttctgcagaaagatcagccacattttcgtgtcggattatctgtaggaaaaaaagtaggaaatgctgttaaacgaaatgagatcaaacgaaaaatcagagcaagtctcacggatatgcaacctagaatcaaacctacactcgatttcatcgtaattgctcgtccaagtgtttcgaattgctcttctcaagaagtatactcgaatttagagcatgtgttaaagcttgctaaaatcattaactaacggaaaggaattatttaagtgaaaaaaggaaaacgtatcttactatttttggggatcgtctcattggtagttgtcttgtctgcctgtagcgcaactggggaagtgaatgcgcaaagttcaggattatgggatcgttatatcgtttattactttgctgaagcgatcaagatgctatcttttggcaatgctgggattgggatcattctatttactctgatcattcggattattctcatgcctttaatgcattttcaaacaaagagtatgcgaaaaactcaagaattgcagccaaaattaaaagctctgcaacaacaatatgcatcgaaagatagtgaaacacaaaataaattacgtgcagaaacgcaacggctttatgcagaaaataatgtgaatccttatgccggatgtttgccgctacttgtccaaatgccaattttgatggcattatggcaatcgatttcgcgggttccagctttacaagaaggaaaatttttgtggttacaattaggggaccgagatccttactttattttacctatattagctgcactatttacatttgcaagtacttatttgtctagtatgagtcaaatagaatcaaatgctagtttaaagataatgaattttgcaatgccattgatgattttattgatggggatcaatatcgctagtggtttatctttatactgggttgtatccaatgcattccaagtagtacaaacgttgattttgaataatccattcaagattcgtcaagaaagagaagaagctgctcgaaaagaaagagaacgagaaagagcgctgaagaaagcaatgagtcctaagaaaaaacgtaagaaataaaaggaggttgcagataatgccgatttatgaaggtcttacagtagatgaagctatccaagaaggattgcatgctttaggtttaaacaaggatcaagcagtgatcgatgttttggatgaggggaaaaaaggttttttgggtattggtaaaaagaatgcccgcgtatcaattgaaagaagtgctgcggatgaatcaaaaatcatcacagaatcagtaactgaaataattgaagaaatcttagaacctgaacttgaggaatcagtgcttactgcaaaatcgcaagcagatacggaagaaaaacctaacgcaaaggatctttctgatgatgaagcacttactcatcttgctttatatttgactaacatttctaaagcattgaatgcaccagcccttgtaaaaacagcacgagaagatggcttgatcgtttttcatctagatacacaaaagcaaggactcctgattggaaaacatggaaaaacactaaatgctttacaatatctggcacaagtatatattcatcgaatcgcagcaaataagctatccgtggttgttaatgtaggtgattatcgtgaaaagcgtcaggcaattttagagcgtctggccaatagaacagcagaaaaagttaaacgcacaggtagaccagtctttttagaacctatgccagcttttgaaagaaagcaaatccattctgcattaagtaaggatgcccaaatacaaacacactctgaaggtgacgagccttatcggtacttggtggttgaaccagcgaaaaaaaacttttaagtctaaaggaattgacaagatatttgaaaccaagtattcttgactagaaatcattcttatcaaagtaaacatacgatgagtagttcttactttggtgaaaaaaagagtccgtttgccacggactctttttttatattaattgtattggtagtatcgaggtttagcagtttattgttgagggaaattagccgccgattgtagattgtgtaaactgtacaactgttccataagcaaaaatttctaaaaaagttttcccgttttctacgatccgatcatgttcaaaatggcagttgattacagcattagcaccataactgtgcgctttttctttcagacgaaaagcaacatcagagagaagcgcattcaaatcgatttcaggatcaaataaatctacttcaattttatctgcggcaaagacaatatcgcgaacaatgtatggccgattgacatttccggtagaaagaatgatttccttgatgcgagaagaagtatctatttttttggacgtatccataaaaatccctcatttcttattgtttcctttattttaaatgtttttagtgtttgatgcaaaagattaaaagtttaccaagtagacttgcgacaaaataaaaagtatgctaatctattcccagaattttatatgacaagcagtcaaagtgctaagtctatccgttatgagtttgacgggtggagtgggcgctttttttatgcgaaaaattaggaggagctttagtatggtgagtattacgcaggaatttgatacgattgcagcaatatctacgccccctggtgaaggagcgatcagtattgttcgattaagtggtgaacaagcaatttccatagcagatgctgtctttcaatcaggaaagaaaaaactaatagatgtgagtagccacacgatacattatggccatatttttgaccctgagaagtatcaaatgatggatgaagttatggtatcgatcatgagaaaaccaaaaacttttactagagaagatatagtagaaatcaattgtcacggcgggattgttgtcgttaatcaaattttgcaattagttttgcgtcaaggagcacggttggctgaaccgggagagtttacaaagcgtgcttttcttaatgggcgtgttgatttatctcaagctgaagcagtgatggatttgattcgtgcaaaaactgataaagcaatgaatctcgctatcaaccaattagatggtaacctctcaagattgatccgacaactacggcaagagatcttagagacattggcacaggtagaagtaaatatcgattatccagaatatgatgatgtcgaagaattgacaacacgtttattattagaaaaggcaaatcaagtccagaaacagatacaagctcttttacagacagcacagcaaggaaaaattttacgagaaggtctcagtacagcaattattggtcggccaaacgtaggcaagtcaagtctgctaaatcacttattacgggaagagaaagcaattgtaacagatattgcaggtactactagagatgttattgaagagtatgtaaacgtacgtggtgtgcctttaaagttagttgataccgcaggaattcgtgaaacagaagatatcgttgagaaaattggtgttgaacgtagtcgcaaagcactcagtgaagcggatttgattttattagtactaaatcaaagtgagtcactcacgacagaagataaacaattattggatattacatctggaaataaacgaatcattttgctaaataaaacagatttaccttcaagaatcaatcaagaagatttagtgccctatttagagaatgagcctgctcttcctatttcggtattaacgagtgaaggattggatcaacttgaacaagcaatagctgacttgttttttggtggaaatacaggagacaaagatgcttcttatctctcaaacactcgtcatattgcattattggaaaaagcagaacattcattagcagaagtgattcaaggaattgaaagtgggatgcctgttgatcttgtgcaaatcgacatgactcgttgctgggattatttaggcgaaattgttggagatagtgttcaagatgaattaattacgcagttatttagtcaattttgtttaggaaaataaaattaccaaaggagaatacgatgcaagaatatcaagcagaagaatatgaagtcatagtagttggtgcaggtcatgctggatcagaggctgctcttgcagctagccgtatggggtgtaaaacattattgttaaccatcaatttagatatggttgcatttatgccttgtaatccatcagtaggaggtcctgctaaaggtgtagttgttagagagattgatgctctcgggggcgagatggggaagaacatcgacaaaacatacattcaaatgagaatgttgaatacaggtaaaggaccggctgtgcgtgcattgcgtgcacaagcagataaacatgcctatgcttctgaaatgaaaaaaaccattgaaatggagcaaaatttgacattacgccagggtattgtagagaaattgattgttgaggatggtatttgtaaaggcgttgttactgcaactggagctcgttaccaagcaaaatcggtgatcattactgctggaactgcgctacgtggggaaattattattggtgaactaaaatattcttcgggacctaataattctcaaccatccattggacttgctgatcatttaaaagagttaggtttagaaattgcgcgcttcaaaactggtacgccgccacgtgtgaagtcaagtaccatcaactatgatgtaactgagatccaacccggtgacgaagcccctaatcactttagttacagtacaccagatagccaatacaaaaccaatcaagaaccttgctggttaacctataccaatgaacatacacatcaaatcattaatgataatattcatcgtgcaccaatgtttactggaatcgttgaaggggttggagcaaggtactgcccttcgatcgaggacaaaatcgtacgttttgccgataaatcacgccaccaattatttttagagccagaaggtttagataccgaagaagtgtatgtccaaggactttcaacttctcttccagaagacgtccaagtcaatatgctccattcgattgccgggcttgaaaaagttgagatgatgcgtacgggttatgctattgaatatgatgttgtagtaccacatcagttacgaccaacgttagaaacaaaagtcatcgctaacctttttacagcaggacaaacaaatggaacgagcggatatgaagaagcagcgggtcaaggattgattgctggcataaatgctgctcttaagattcaaggaaaagagccttttattatgaaacgtagtgatggatacatcggagtaatgatcgatgatctagtaacaaaagggactaatgagccataccgtctattgacatcgagagcagaatatcggttgttgctgcgtcacgataatgcggatcttcgtctaacagaagtcggacaccaaattggcttagtggaagagccacaataccaagcctatctaacaaaaaaaacagctgtagaagaggaaatccaacgtctaaaaaaagtacgtatcaaaccaacaccatctgttcaaactttcctcaaagagaaaggaaccgctccattaaaagatggtgttctagcaaatgaatttctacgccgtccagaagtaaattatcaagaactcttgcagtttatcgaagcaaaccctgcattaaagccgaaggaaattgagcaagtagagattcagatcaaatatgaaggatatatcaaaaaagcccttgaaaaagtagaaaaactaaaacgcatggaagcaaaacggattcctgaaaacattgattatgaagcaatcaatggtcttgcaactgaagcaaaacaaaaactacaaaaaatacaaccagaaaccatcgctcaggccagccgaattagtggcgtaaatccagccgacataagtatattgatggtctacatcgaacaaggaaagattgcgaaaataacagaaccagcctaaagaggctggtttttttattcggaaaagtcgtaatctttttggtgactaccgtcttttttaaatacttctacaccagtttttttattttcagcgatttcttttgcccgagcaatggcatcttctttaatattaaaatgatcactagctcgtttagcgccttcagataaaacaatccatttatcttcttcaaattttacttgaacattggctgtcagaagtttttttgcatttttatttttggtatgcggatcatctttttgaggatttttttccttacgaaattctttcttttcttcttcactggcattttctagccatttttccgcttggctagtagcaataggaattgcccgatcgtctgtatagccatcattcaacaaagcatttgcaatatcaattgctttttttcgaaccaacggatccaagtttttcattgaagcaggataatctttcatattccaaggcattttgtactcccccttttttcttttagtttacctacttttgccaaaatatggaaaaaattgaatttcagtacggaaagagaaataaattattttaccttctatatccttattaaaaccctctttgtgtacgctttctttgctcattttttattgaaattatttttgattttaaaattaaataagcgttatatttccaaaaaaaaatttaatggtttagaattttgttatagacaaaaggaggatgtaagatgagtgaacctattttgaatgatccgcgcgaactttatcaaacaggtaaatttaaaaaacaggatcaagatactcctgctttgcaagaagaaatgatgcctgagccggattgtggagaagaaacatatgaaggaacaaatcaattagaaaatcgacgggtactgattacgggtggagattcaggaattggtcgagcggcagccattgcttttgcacgagaaggggccgatatcgccttacatttttttccaggagaagaaaaagatgccgaggaagttgctcactatatcgaacatgctggacgtaaagctatcctattaccatatgatctgagagatgaagcagctcctcaagaaatcgttgaaaaagcagtaaaagggctaggcggtttggatacgcttgttttgaacgctgcgcaacaaatcacacgtccctctatttcagaattaccctttgagcaagtaaaagatacgttcatggtgaatatattatccatgtttgctttagttaaagctgcagaacctcatctcccagcaggtggggccattgtgacaacgacttctgttcaagcttttagtccaagtgctcatttaatggattatgctgcaactaaggctgctattgctagtttcacagttagtttggcaaaacagtttgctgaaaagggaattagagtaaacggtgtagcaccaggcccaatttggacacctctacagttggatcatggacaacctcaggatcagttacctgaatttggccaaaattcgttgttacaacgtgcaggacaaccagccgagttagcacctgtgtatgtttttctggcgtcgaacaaagcaagctatgtaacagctcaaatttatggagtaactggtggagaagcaatcaatctataagaagtgatcaaatattaggaggtgtcttatgaataaaggatggaaaactttagcgattgtagtttcattgatttttattactgtgttattgccaatattattattgggcaatccttattttagtttaccgtttggcttagatcgaaaagaaagatttatttccttctttttcacgaattatttcctacaacaatatcttttttgggcagcagcagttctaattatctttttcctttgtgtcattctagttattatcttctatcctagaacaaaagctacttttgttttgaaagaggataaaggaacattgtcgattgataaaaaagcaattgaaggtttagtacgaacaaaggttagtgaaaaagaatttgttgatggacctaaagtgaatgttaaagcaactaaaaatcgaatcagcgtaaaaatcaaaggaagattaaaacgtacttctgcattggtaggtaaaacagagaatttgatgactgagatccagcaagatttgcagagaacgttaggatcaagtgaaaaagtcaaagtcgatgtttcttatacgaactacgaagaacagaacactacagaaaatccacgtgtagaataggaggtctatcaatgaaagagcttgaacaatataagatccctattatctttggagcgattggattagtgttagctttactatttgtcagcattggctttttcaaaacactactgatcattatgctcacaggattaggctttgccctagggatgtacgtacagagaacgggaatgttagatcaatttctaaaacaataagaactcaggaggaatttaaatgaataacgaaaaaaacgaattaaaaaatgaaaaaccagtaagtgcacatccagatccagtcgtaccaaacacggatcatacgacaaaagaaaacgatattccgatgacagaagcaccagacccagttgtacctcatgcgcaagaagcggttgaacagcaccaagcaacagttggaaaccaacatcataatcagacagaaaaacctagtggatttcaaggtcctactggagaaacatccgtaaatggttctttgacctatgatgataaagttattcaaaaaattattggtatcgctctggaagatgttgatggtctgttaacagttgatggagggtttttctcaaatattgcagagaaattagtaaatacagataatgtaacctctgggatcaatactgaagttggcaaaaaacaagtcgctgttgatatggatattgtggtagagtacggacgaaatattccagaagttgcggagagagttaaagaagtgattcatagagaagtagccaatatgactcaactagatgtaattgaagtcaatatcaatgtggtcgacattaagtcagaagctgagtatcaagaagatagcgagacagttcaagataaagtctccaacgcggcatcaaaaacaggagattttgcttctcgacaaacagaaaaagctaaaggtgcagtagaacgaacatctgatcgtatgcaagaaaataatgaacctcgcgttcattaattaataatagaaaaaataagagctatccttcatgttgaagggtagctcttattttatcgatcaatttttttgaaaaacagattctttctatattatttaactaaaaaattgatagaactgataatacacttttacagctgcttactgactattcatacaagtaacaatttcatcagaatacagatacaattttgtaattgtattttttaagtctagtgagttagtatttaccggtcatggaaaatgatgcatttttttgtctgagtacaagttcaaatttttgccataaactaaccacaaacaattaaataaaaaccgtcgaggaaaaattaaaatctctttgaaagcaatgtattcctattgcatctcaaaactttttgcgttaaagtaggaattagtctgtgaaacatttttctgtttcacaaaaatagaaaggattcattatgctgccagaagaatttcaaaaacaattatctattcaaggaattgagttgtcatctgaacagctcaagcaatttgctacttactatgatcggttgattgaatggaatcaaaaaatgaacctcactgcaattaccgatcaaaaagaagtatatttgaaacacttttatgattcgatttctttagcttttgtgacagcattcaaagaagatgcacatttatgtgatgtcggttctggagcaggttttcctagtattccattgaaaatcatcttcccacaactaaagataacaatcgttgattcactgaataaacggattacttttctacaaactttagtggcagatttaggtttaaaagatgtttacttgtttcacgatcgagcagaaacatttggtcaaaaagagttccgagaatcctttgattatgtcactgctcgagcagtagctcgtttaaatattttaacggaactatgcttgcctctcgttaaaaagaacgggtatttctttgccttaaaagcagcaaaaagcgaagaagaattaatagaagcaaaatcagcaatcgcattacttggtggtaagtttattgaagaaaaaaaattgacattgcctgttagtaatgatgaacggcatcttttgatcatcaaaaaaacgaaagaaacgccaaaaaaatacccgcgcaaacctggtttgccggcgaaacaaccaatcaagtaggaggaagcagaatggcacgtattatttcggtggcaaatcaaaaaggcggcgtaggcaaaacaacaactacagtcaacctgggtgcttgtttggcttatgtaggaaaaaaagtcttactagtagatattgatgctcaaggaaacgccacaagtggagtaggaattcgtaaaccagatgttgataaagatatctacgatgtattggtgaatgaaacaccaatcgtagaggcaatattgccaagtagtcgtgagaatttagatattgttcctgcgacgattcaattagctggtgctgaaattgaattaacttcaatgatggctcgggaatctcgtttgaaatcggcattgaatgaaatcaaagatcaatatgactatatatttattgattgccccccctctcttggacatttgacgatcaacgcatttacagccagcgactctattttaatacccgttcaatgtgaatattacgcattggaaggactaagtcagttattgaataccgtgcgtctagttcaaaagcactttaatcctgaattagaaattgaaggtgttttgttgacaatgtacgatgcacggacaaatctaggtgctgaagtagtagaagaagttcgtcgttatttccaagaaaaagtttatgagacaattattccacgtaatgtacgcttatcagaagccccaagtcatggtctatctattattgattatgatccacgttcaaagggtgctgaagtatatcagacattagcaaaggaagtgttgactcgtgaaaaataaagggaaaggtttaggacgggggatcgatgcactatttcaagatcttcaaggcttagaagaagtagatatcaaaacagaggaagtggttgagctccctttaaatgaattaagaccaaacccttaccagccacgtaaaaccttcgatgaagtctcacttcaagaactagctaattcaattcaacacgcaggtgtttttcagccgattattgttagaaaatctactgtaaagggctatgaaatcattgctggtgaacgacgttttcgtgcatccaagttagcaaaaaaagaaacgatacctgcaattatccgtgattttgatgaagaagcaatgatgcaagtagctgttctagagaatctgcaaagagaagatttaaatcctttagaagaagctgaagcgtatgaaatgctgatgaaaaatcttaaattaacacaagcagaagtggcaacacgattaggcaaaagtcgtccttatattgcaaattatcttcgtctattatcattgccaaagttggtaaaagagatggtacaagatgaacgcttatcaatgggacaggcgcgcacactgctagggttaaaaaacaaagatctgattttaaaattagccaatcgatgtgtgaaagaaaatcttactgttcgccaattagaacaattagtgtctgaaatgaatgatgctaaaaatgagaagaagaaaattcctcgtttgattcgtgaaaaaccctattatttgcgggaaagtgaagaacgactaatggacaagtttgggacaaatgttgaaatccatgaaaaggaaggtaaggggaaaatagagattgagtacctttcacagaaagatttaacacgaatccttgatttattgaacattcaatttgatgaagcttgaggtgataaatatgtatgatcttggtgacattgttgaaatgaagaaaccccatgcatgtaaagcaaaccgttgggaaattatccgtatgggtgcggacatcaaaataaaatgtacgaactgtggccatattgttatgcttactcgccgtgagttcgacaaaaaaatgaaaaaaatcctagaaaaaaaagagaaagagtgaaataataaatggctttaactgctggaatcgttggactacctaatgtaggtaaatctactttatttaatgctataacgaaagctggagcggaagcagcaaactatccttttgctacgatcgatccaaatgtagggatggtggaagtccctgattggcgtttacaacgtttgacggaattagtacatccaaaaaaaactgtaccgacaacatttgaatttacggatatcgcaggaatcgttcgcggagctagtaaaggagaaggactaggaaatcaatttctaagtcatatccgtcaggtagatgctatttgtcatgtagtccgttgttttgatgatgacaatattacacacgttgaaggacgggtagatccactagcggatatcgatactattaatttagaattagtcttggctgatttagaatctatcaataaacgttatgcacgtgttgctaaagttgcgaaaacaaaagataaagatgctgtagctgaattagcagttttagataaaattaaacctgttttagaagaaggtctatccgcacgttctattgaatttactgaagaagaacaaaaaatcgttagaggattgtttttgctgacaacaaaacctgttctatatgtagcaaacgttgcagaagatgatgtggcaaatgcagaagagaatccctatattaaaagtgtgaaagaatttgccgagagtgaacatgcggaagtgatcgtcattagtgctcgagcagaagaagaaatcgctgaattggatgatgaagataaagcagaatttttggaagctttaggcattgaagaatctggtttagatcaactgattcgtgcggcctatgatttattaggattagccacttactttacagctggggaacaagaggttcgtgcatggactttccgaaaaggaatcaaagcgcctcaagctgcaggaattattcatacagatttcgagcgagggtttatccgtgcagaaactgtttcctttgaagatttggataagtatggcaatatgcatgcagcaaaagaagctgggcgtgttcgtttagaaggaaaagaatacgtcgttcaagacggcgatgttatgttattccgttttaatgtataaaaggctttcttccaaaaaaaaatatggtaaaatgtcctttgtgaagaaatcacgcagaagggagaaatgatttatggaaccagaaactctgcgctcgtatgtttccgaaaatcgtgaattagaaaaacaactaacaaaacgtaaccaacaatatatttttgatttaaaaaaatctttggaggcagctaatctttctgaagaagaaaaaactgtcgcattacatgagatgttaccgattcttgttcaagaacaaaaaggtggtaaaaccgctagacaactttttgggacagtctctgaacgtacggaagcaatcatcacgaagccagttgaacaaaaagaatcaggtccattcttgatgtggttagacaatacgttgcttattttaggtatttttggattaatgctcggcgtgatgggggtatttacaaaaggtcaagcacagccttacggattgttgaccctcttcttaatggccatgttagctggttgggtcttctacttaatgtacaagtacatgtatcaatatgaacgtccaggcgcagataaaagtaaacgtccgaaaatgtggaaaattattttgattttagttggagctttcttagtatggatcgtgactatctcactttctgctatgcttcaaccaccacttaatccacaggtcgacccattaatcgaaattgtgattggggctgtggcactagcagctaaatattacttgaagaagaaatacaatattattagtagcttatctgttcctagaggataataataagttcccacatgtcattcatgcgtgtgggtcttttttattatgtgtcatacaagagggagaaaatagaaatcttttgtgattctggctgttttctcagattacacaggaataaataagaaagctttccgaatagttgacttatgaaaaaatatttgctatttttttaaaaatacatattaactttaaggagtggttacaaaaatgtccaactgggaaaccaaatttgtaaaaaaagggttaacgtttgatgatgtattattgatacctgcagaaagtcatgtgttgccaaatgatgtggatatgcatgtgcagcttgcaaaaaatattacgttaaatataccgatcatgagtgccagtatggatacagtaactgatagtaaaatggcaatatcaatggctcgtcaaggtggattaggggtcattcataaaaatatgagtattgctgcccaagcagatgaagtgcggaaagtaaaacgttctgaaagtggcgtaatcattgatccgttcttcttaacacctagtcatctagtagcagatgcagaacaccttatgagtaaataccgaatcagcggtgtccctattgttgaaacaatggagaatcgtaaactagttggaatcatcacgaatcgagatatgcgttttgttacggattattcaatcgcaatttctgatgtaatgaccaaagaaaaattagttacggcaccggttggtacttctttgaaagatgcagagaaaatcttgcaaaaacataagatcgaaaaattaccgatcgttgatgatgaaggtattttaagtggattgattacgatcaaagatattgaaaaagtcattgaattccccaacgcggctaaagacactcatggccgtttattagtagcggcagctgtaggtgtgaccagtgatacctttgaaagagcacaagcattgttagatgctggagcagatgcgatcgtaatcgatactgctcatggacatagtgcaggcgtactgcgtaaaatttctgaaatcagagcacattttcctgaagcaacattaattgcagggaatgtcgcaactgctgagggaacaaaagctctatacgacgctggtgtagatgtcgttaaagttggtattggtcctggttccatctgtacgacacgtgttgtcgctggtgtaggtgtccctcagttaacggctatttatgatgctgcctcagtggctcgacaatatggaaaagccattattgcagatggtggtatcaaatattctggtgatattgtcaaagctttggctgctggcggacatgcagttatgctaggaagtatgttggcaggaacggatgaatctccaggggaatttgaaatttatcaaggtcgacgtttcaaaacctatcggggaatggggtcactaggagctatggaaaaaggttcaagtgatcgttatttccaaggtggagttaatgaagcaaataaacttgttccagaaggaattgaaggccgagtggcttataaaggcagtgttgcagatattttattccaaatgatcggcggtctaaaatcagggatgggatatgttggagcagcgaacttaaaacaactaagagatgaagcacagtttatccaaatgagcggaaatggtttgaaagaatctcaccctcacgatgtgcaaattactaaagaagcaccaaactattctgtgaagtcttagaaattgtttcacgtgaaaacattaaataaaaaatggcggccagtagtcttaataagacactgaccgccattttttgtatgggaaaattattcatttgatttcaatgcgtcgatcatatcaacatgcttcaatttataatgagtaaccaacataacaatgattgtaaataaaatggtcatgccgccggctaacgcataagcagcccaactaatcactaatggaaaaaccatgttttccatcgatgcctgtcggagaataaaatcagtcagtaagtatccgactccataaccagctaggatccctagcaaagtaaagacaacattctcacgaacaatatacattgtaacttctttgtcgtaaaaacctaaaactttaattgtagagagttcccgaatcctttccgatacattaatgtttgttaaattgtatagaacaacaaatgccaaggcaccagataaaatgaccaagataagaacaatggaattcagattccccatggactcattttgcgctttgatttgactagacaggaaggtagtattctgaacttggtctgttttcaatagttctttagctaatgcgtcttcttgcttttgttccatctttttactcttgataagaagcgatgtaggctgatagttcgtatttgttgctttttcatagtcatttctagaaagataaagtgagttacctaaataattttcagcgataccagctatcttcactgttacagctgtttgatccttatcataaaaggttagctcatctccaatgtggatatcaaaaagctccgcatatttcatcgttaggatggccccatcatctagtgacattttttttccatcggtagagtgtagatgcatatagttcgagaatgagtcagtatcagaaggtaccactaaagacagactttgctttccttgttctttggaccgtaactcaattgtttcattcaatacaagcagggattgttgaattgttggatcttcttctaatatttcaaaaacttcggtattgtttgttttactatcttttaatgtgacgattgcttgataatcagtgataggaccaaattgtttttgcgaaacagcacttaatgaatcttttagacccactccagcgaccataagtcctgcacatcctgcgatcccaattattgccataatcattcgtgatttatagcgaaaaatgtttcggtaactgattttttgattaaagctcaagcgtgaccaaagtggttgaatgtattctagaaaaattcttttccctggctttggtgcacgtgcctgcaatagttgcgctggtttttctcgcaaatcacgatagaggacaacaagggctgcacctaaagtagcaagaataaaggcgactgtagcttgaatgattggcccccaaacatagtaaacccggacaccacctaaaagataccgttcactagaaagaaaatagattaatcgaggtagaaattcgatacctagtacagctcctaagagaattcctatactagatgataaaagagcatagatgatatattttcgagctatctctctttttgcatatcccaaagcctttaatgtgccaatttcttttcgattttcttctaccattctagtcatggtggtaaaagttattaaagctgctacaaaaaagaagaatactggaaagacatttgcaattgccgctatacgatcagataaaccgccgtattcttgaaacccaggattatcttttcttagattaaataaataagtaggctcttccatttcatttatttcattttcttttttttgtaatgtagattctgcatcagctaacttctctttttcttcattgatttgattttgttgtttaatcaatgtcgattcagcagttttcagttgttcaatagcaccagcttgttgttgagacggtaacagaagggttgcacttttttgttgttcaatctgagctttagcagcatctaattctgtttgtgcatctaatagctgtgcttttccagtttcaattttttccttagcaggtttcaattcttccattgcgtcatgtttgatttctgctacacgttcttgtggacgatcagcaaaaagcgtttctactttttcttgattcttttccattttttcttgataggaatcagagtaagtttctaaatctttcacattatcaaaagacagatagagcaccgattggacatcactcagaaattgattttcgggaaggtaagcaaaatatgttactgtaccactgccaacattcgcatagcctcgttcagctttactgataaataggggcgagttggcaaaaccaacgattttgaagtttttatcctttatagtatcctgcgagtcgatagtataagtatcgtttaactgatagccatattctttcgcttgtgtatctaagacaatttcattgctattctttggtaaatggccttcttcaaggattaatgcgttttgtttttggcttttgttgtaagaattgatttggacaacttcatctgcttctgctacataataaaattggtagcctgattccacttgaatccctgactctttagctactttaagatcttgatcggtgatacctagtgttgatgtaacctgtatatcagctaagttatgttcatcaacataagtacttgcagaatgattcaaaataggcccagttgctttgacacctacatacaaaaaagtacctagaaagatgattaaaacaatagcgataaatcttcctttagactgtttgatttctcgtaagcttgcttttaaatacgtcttatttttcatttgtttcctcctaccaaacgatctcatcgattgaaataggggattcattaatttctacagagcgcactgtagcatcattaatacgaatcacgcgatcagcaatgggagcaatggcactgttgtgcgtaatgattaaaacagtatttccagcttgacgacttgcgctttgcaacagcttcaatacttgtttaccggtttcaaaatctaatgctcctgttggttcgtcacaaagaagtaatttcggattttttgctagcgctcgggcaatggacactcgttgctgttcgccacctgataattgagaaggaaagttattggacctattttctaatcctacttgcttaagcacagcatctgggtcaagtgcgttcggtgatatctctgttgctaactcgatattttcttttgctgttagatttgggactaaattataaaattgaaaaacgaagcctacatctttgcgccgatattctgtaagttgtttatccgaaaattgtgcaatatcaatattatcgataatgatttgaccttcatcaggtgaatccatcccacctaatatatttagaatagtcgattttccagctccgcttggacctaaaataacgactagttctccttcttcaattgaaaaggataggtcttcattagcggtaatcgtggtttcgcccattttatatcttttatacgtattttttacttctacataactcatataacgcctccatattttgaacacctgttgatttaatcacatagcgttagtatactaagaaagaaaaaaaggggcaatcctcaaatcttattcatctgttattaaataaacatttaagttatttttgtatagaaaggattgaagttatggtaggaatagttggaaatcgccgaacacaatatacaaaaaaagtgattcgaaaagcatttcaagagattttgatgggaaaagaatttgaaaaaatcacaattacagagattgcccagcgtgctgatatcaatcgaggaactttttataagtattacaaagatactgcagaccttttagaggagattgagaaagaaatcgttgaacaaattgcagataatttgcaacaagaaaatctcccattagatctatggctagaaaaattattacttatactgcaagaaaatcctagtgtaagtcatttgattctgcttaataacagtcatttattagatttgttattggaaaaaatcagaccggaaacgtttaaacgctttactatttatttcgaagacgcaacaagagaagaattagagttatgtttgagttattttgtctgtggctcgatcgggttgattgaacgctggctaaaagatttttctgagatgcagcctaaagcagtttctcatttacttattcaaatatttactacaaatgtttatgaataaaagaaaagcgaacgccaatacgttcgcttttcttttattctactagtcgttcatcattcataccaaaatattgatgcaatggtttttgttttcctgacaatagttgatcgatcgtcacaaattcgtatccttcatgttttaacatagagatcaatcctggtacagctttgactgattcaggatggatatcgtggattaagatgattgcgccattaaagacattctgtttaacaacattattgattgttccaggattttttgatttccaatcctgtgagtcaatatcccattgaataattggcatgccaattgtttcagcactttttttatcaatagcgccataagggggacggatattgcgaggcaagacgcctgtagccttgaaaatagctttgttggttttatttatttccctttgtaattcatctgtcgaaagtgtattcaattgtggatgagaatacgagtgacttgctacctcatgaccctcgtcgtggacttgttttgcaacatctggattttgatccaccatctgtcctaacatgaaaaaagtagctttcacgttatctgtttttagtatattcaacaaatcaagtgttgagctattatttggaccatcatcaaaagtaagagcgacgtactttttattttcatctaatgcaggtaatgtatcttttatactttcttgcgaaaccagatctgtatcaatgaatggagcaatatctttgtattttagagtgactttagaagttccagttgaattttttggtaagacgatagtcaattcatcaggtgtataagtcattttactatcataagaaattctatccattgttaatacagcatcaatgattttttcaggttctttggcttgatcaagtatggattgctgaatcacctgttgaatacctaagagacttccttcatctggaatcaaatccttatttgtgatttctttgccagttttttcggaaacataaatggctttctcagaaatactgtctggctttttaaaattttccttactgcgatcccagataaaactatctgcttcaattctatactgaccaattttagaagatattgctgttgcttttattctggcaactgtaagcacttctttttcacgatgctttttttgttgcttttgagcaagctcgtctaagagctggtttgcatttttgaaaggaacagtattttcatcaactggacggtaaacaaggcacttattttctccgtcatttatagtatctattttcgttgaaattccactttggtcttgctcttcttggattgaagccatgagattttttgcagcagtttcatatttggcttgagcttctgcttcttgctgttttaatgtataaacaatatagccgccagtagcgacaattactagaataagtgcggtaaacaatgcgaatatatacttgctataattagattttttcttcggtattttttgttgtttgttttcgtttccggttttgggctttacagcttcattcaattgatttgtattttcacaggtatcaggttcttgtttgtgacgttggctacgacgtgcataggtatttttgtcagacatatgactttatccctccatttatcatcataaagtaaaataaacgtaacataactgtaatatagtttcaacaataggggggtatttcttagaatatttaaagaaaaaaggtaggaattctcatcctaccttgttcttcaatttttttcaattcgggtaactccacccatataaggaactagtacttctggtatagtcacactaccatcttcattttgatagttttctaatacggcagcaacagttctaccgactgctagtcctgaaccatttaatgtatgcatgtaatgaatcttgccatcgttatctctataacggatcattgctcgacgtgcttgaaaatcttcacaattagaacatgaactgatttctcgatatgtttcttgtgctggaatccatacttccaaatcatacgttttagcagcagagaagcccatgtcacctgtagacaatgccattactcgataaggaagttgtaatttttgtaaaatgtcttctgcatttgcagtcattttttctaattcttcataagagtgtgctgcttcacttagtttgaccatttcaactttgttgaattgatgtaatcgaattaatccgcgagtatcacgaccagcacttccagcttctgagcggaaagaaggacttaatgctgtgaagtaaaccggtagttggtcaagatccaatatttctccattataataattcgttaaaggaacctcagcagtaggaatcaaggtaagatctgtttccgctaattggaaaacatcttctttgaatttaggaaactgtccagttccaaacattgcatcgctattaacaatatatggagtaatcatctcagtgtacccatgttcataaacatgttggtctagcataaagttatataaagctcgttcaagacgggcacctaatcctttatagtagacaaaccggctaccggctacctttgcacctcgttcaaaatctaatattcctaggttttcggcaatatcccaatgaggctttgcttcgaaatcaaattcttttggtgtagcccagcgtcttacttcaacattgtcatcttcatcttttccaactgggacagagtcatgaggcagattaggtaatgtcgttgcgatcaatttgatttctgaatcaatttttgcaatctcgtcatcaagagacttgattttagtaccgacttctttcatctcagtaattttatcatctgctgctttttttgctcgttttagttgagctatttctgcagaaacttcatttcgaactttttttaattcttctgtctctactaggagttgtcgtctcctttcatctaactttaagaattcttctaatacttctttttttactccgcgagtctgtaattttgtttggactttgtcaaaattttgccgaatcattttaatatctaacataattcttcccccttgtttttcatataaaaaaagaccttttcatccctattcttgggacgaaaagatctttcgcggtaccacccgagttcagcataacgctgcccttgttgcccgtaacgtgggcacacgatctttctttcaaaagatacacttttaatgaactggattccattctttccattactgattctcaccaaccatcagttctctgaaaaagtaaaaaatgtactaggttctatgctttattagtaagtattttctctagaatagcgaaaaagcgttagttcgtcaaccatagttttgggtatttgataaatcatttctctttaatgggagatggataataaaggaggtccaatccggagtagattttgcaaaaatgtagccaccatgcaaggcaacgatgctttgagcaatggcaagaccaagtccagttcctccagtttcctgcgaacgtgattcctccactcgatagaagcggtcaaataaggagtctaatgaatgtttgggaatcatttgtccattgttcttaactgttagaatggcttctgttcctactttttccacttccattacgattttgtcagcgccttttccatactttaaagcattagacaataaattattgaaaactcgtacaagcttctcagtatcaccgtccataataatgtgctctgggcgagtgtgagtctcaatctttattcctttacgagatgcttctaattcaaaatctgcagctagttgttcgactaattgcgccatatcaaaagaaatgacatttattgggacgctaggctgtcttacttttgtgtattcgaaaagatcgtctactaaagatttcatttgctttgctttgacataagcggtatgagtatatttcaataactcttcttcagaatgatactgacgatcttcaatcaggcctagataaccaataatagaagttaaaggggttcggatatcgtgactaacatttgtaattaattcatccttcgactgttcgatccttcgttcatcttcaatggcggcgacggtactatctaccaagccgttaatatttgaaacaatccgattgaggtcaccacgcagttcaaatggaatacgatgatcatagtttccctctgcaatataatgaagctcactaataatatgccgtagctgcatttgacggtatcgacgaatcaaacgccaatataaaacaatcacatctaataaaaagaacaaagggataatgaaattgcggccactttgaaaaatatccgtgtcaaaagcagaagtaaaagcgttttttgactcatagatcgcctccactaacaacggtgaattctctcttatagaagtcaagatgactaaaatcgcgacatttaatagaagtaaaaggattacagtaacgattccttctgcaaataattcactgatttctttagaagtgagggtgatacgtttctttttttctattggattacttcgcatctattttatagccaactccccacactgtttgaatgactttctcgccatcagttgcttcttctatcttatcacgcagatgactcacatggaccattacggttttggctgacacgacactctcttgcttccacacacgctcaaaaatttcatcagcactaaatacacgattcggatgggatgctaataggtagagaataccaaattcaagagcggtcaattggatctcatttccggtgattgtttttacttcatgagaatcacgattaatgatcaatgagctaacttctaagatatctggctgattagagggagcttgcatttttgttcgacggagcagagacttgacgcgagccatcacttccaaaggattgaatggttttgttacatagtcgtctgcaccagcaactagacctcgtattttatccatatcagtagtcttagcagttagcatgatgattggaatttgtgattcttttcgcaactcttttacaacctgcatgccatccatttcaggcatcatgatatccaatatcagtaattcaatatctggagtagttctaatttttgttaaagcttctttaccatcataagctttgacggcttcataaccttcattatgaagatagatacttaatagttcaacaatctctttatcatcatcagcaacaagtattttcatataaatcctcctaggaacaatattcttttctcctattttagcaaatattctaggaaattgataaaatcatacttaaatttataagaatgataggaaataatacttacaacaagaataaaaaccgaacattgagaattcaaataatcatcatagtttccaaatggagagattattccatagaattaactaaaatatatgatggaaccgcagtatttagaaacgttgaaatatcaatgattttactgttgacgaatggcaagatagttgctatattattacatgtgccaaatgacaaaaatcatttctaaaagaaaatgaaaaaagttgttgacgccagaaccaacagatgatattataacgaagtcgcaaatttaagaaatcaatttgatgctgatacagcaacaaaaaagattgaaaaaagttgttgacaaataacaattcatttgttattctaatggagtcgctgatgacgcacaggaagttgttgaataaacactttcgaaaaaaacttttaaaaaaagagtttctttgactgctggtagaagaatttcctccagatacagtcggattgcttagtcgttgcgattgatcagcagccttacctttttctaccgctgtttggatcgttgggcttttacttggcgttgtaagaggtggaatcgttgctttttgtcatgatatgacctccaaaaaaataatttattttagaagtccgcacgcatatgttagaataaactaacaatcttcgagggttgcgtacggacttgcctaacttgcttaaatgtgagagggcaagttctttttttactttgtccagtcatgcattggaatctttggtgtatcagtctttagacctgaaaacgtaaactccagtttggcaattttattgcctttttttgctttgatttttgcgacctttaggtcactgaaatagttttgtaattcccttagtgcaggctgtaaaactttttgatcgatttgtcccatttggcgatagctctcaggaatatccattcgttctttaaaatcttcaattctcacaatataataaccagtagagcgatattgcataagcaatcggaataatgtttttgcataggtagagcgaatcgaagtgaaagcagataatttaaacctagaaacctcagtagttaaaccattgataatgtagtccagttttggattaacactcacatcgacaaacattttagagacattaatttcaaaccctgtaaacaatacgaaacgtttgataactcggtcgccatcttcattgatctcatccgtacggtaagacatacttatcattttttgatagacattctccaaatcatgaacgaatctatcattaccagtaaacttatattcactcaattctttcaactcttcaaaagaaaagcgcacattgtctagtccacgctctttcatacgagcacataatgcaaagaacaaatccatttctttagcgttaaattcttttaaaggcacaaggttcaattcattttgatatctaactgctaaatccgttttcttgtccattcctttcccccctcacattaaaaatataacaaacactaacctaaatgtaaacaggtagtgttagtagtcacacaaaatggtgctggtagtcatacaaaatggtgttggtagtcatacaaaatggtgttggtagtcatacaaaatggtgttggtagtcatacaaaatggtgttagtaccattctgtatcgcctgggagagtaaggcgcaacagccccctaaaagggtttataaaaggtcttataaaagatatataaaataaacgcgtgcgcgcgcgagtttttccacaggtaatttttcccgcccaaatacatcatttctctttcaagtaatcatcttcgcgaatctaataaacagctagtaaagattaaaccctaaacactgcatatttttgtggcacatactattcaaaaagactagaaccacaaccaaaagacctaatttcaagaccccaaaggagtgatcgctacgctctcacattaggcttgcagtgttcactacgttcactcgctaaaatcaaaacattaaataaagtcgggttgggatagggtctggttgctcgtaaaagcctttctaagacgtttttagatcttaaaggtaattatattagcaaaacgccttacaggcggtcagggcaagccctaacaaccccaaaacaacacggttgagaactttgcaaaacaatttaaatgcaagaagtaggaaaatacataaaaataggatcaaatttccaaataattagccttattaggtcttgtaaacgaataagttacaaatacaaccctatgtaaactatgcgtttcttatgttttaagcgggaattatggataatatactagaaattcgcgttaaaaaatcaaattaaatggaggctatatgttatgaaaaaagttattttagtgggattaatgtttgttgttttttttgggtggaaggatattgtatcagctgatagtgttaccgaagaaaatgcagttatcagtgaagtaaaagaacttgaacaaagcggtaaatacgatttcgaagtagtacccgcagaagatattgatccgcaaaatattattcaattagacagtgtagaagaattagaaaaaattctagcagagtttaaaaatagcagtgaaacagaatttacaattaatgagaaccctatacaaaccagagctgctggaagtaaaacagtctctcaatgggctccgtttagtggctatggaatgactggacttcctacttggagaaatgtatccttcaattatgaatacaaaaaagtaaatggtaaaaatcaatttactaaggtttcaggaattaaatcttactattcaggcttacaaattgctgttacttggaatcaaaccagtgcatcttcaaattttgtaaaaacaaataacactaaagacacagtaaaaataaaagtaaacggttattcattattaggatttcaagtaaaaggatttacgattggcgcaaaaatcaatgatacttggaatttctcacataaaatttaaatctattattttaggggaagatcatcatgaaaaaaaggttaaatattaaatggtttattattagtcttataattcctctgataagcgcttttgtgttaaatcctagggagaatacctcagatggcatgacgagttacttaatgggctttccagttccatttattacgtatcgaagttacgatggttttctagagaatagattcttaattttgttacctagcatgtggaagaaagtacaaattgatttagcggtttatttcatatctgttctgatcgtatacgtcataattgcactttttttccgagtgataagaatgcaacaaactaacttaaaacaacgctaacttcgttgctacggagtaaacagatgtgttatatacaagatttgataaaaactatacattgagactaccaaaggaataggagaatttatttatgaaaaaaattattagagcagttcttgtaggattgaccttaacagcttttatggttattgcatttggagtaaatgttcaagctgaggaacaggttattgtagaatcgaattcagcaatatttgaatctgacagtataatcaataacaatgatattttccaaacacaagctcaagctaaggctggtccagtttggtctacgacttcttttacggtgacaaaaagtggaagaaaggttacagctgtttggaaattgaaaacaaatgctataattaaccgagtgaacgctgtttataatattggaattttgggacaaacgacttctccgggaagctattccccaaaatctggtggtgtgactatttctcaaacttggacgtataaaaaaggaggaacttatagaataaatggggttgctcaaatttatacttcaaagggaaatgcaagttgtttttctcctgtacgtgtggtttcaattaattaatatttttggaggatatgaaaattgtacgcgattgaattagctattaccttaaacaaaaacagtgaaaactactctgaaaaatttgatattgtggcgctaccatttattccaagaaaaggggaaaaaatcctatggaatgggcaattgtataagatttcagacgttatgtatggttttgaaacaagtgaagaagagtacggattcatagttagtcctgaaatacaaacgtcaattgcttcggatctttcatataaagtttggctagaagaagttatttaaacccttagttaacataatctcgattaacacaagacgcccgtcaatcaagcgattgacgggcgttctttgtgattttcaattggtctagctatgttgggaacctaaaatactggtaaatcaagcttcttctctttgggtcgtttgtgaagaaaccgggggggcgagtaaagacggtgttatgttccacgctggattcttcgcaagataagcaaaatgttgcttttctaacaagcgtaaaatgcagcggacttgttccgctgttttgtcggacgcaatggctaggcactccacaaagtcagcgggcaaggagaaaacggaacgattcgctgtttgccaccccgtgacgatcgtgggatcgaattcataccgtcgacaaaaatcacccactgataaaccaaggtgccccacgatatacgcagtcacaggatagctgtcaacataagctgaaaacgacatacaccattcatcctttcaacgctatcttagggttcacggaaaaagtgccaccacttcttctgtctttcttgtttcggtcgcacgacttcattttcaggagcaaagtttcctttatgttctgaggggctctcataaccgctctgaggcgttttaatttttttagtattattattcgattctttgtttaaatcgtctgagaagcgttcctgtgacgtcagaagcagtatttgtttgtttgcttgcaaagttagttgttgttgctgatcaagaagtttctgttgttgggctaataatgactgcagctgatcaatttgtacgtccttttgttgcaattgtgcaagcaacttcgtttctatactgtcagagcttgctgtgtcaggaatttcgaacgcttcaagcaactcgggacgtcctagcttgtcagcaaggtgcaacactcccgaccatagcactgtcttgtatcctaggctatttttggcaaggaacgttggctctaggttgtcaacatgtttcctcatggcttgtctactgataccaaaaaattctgcaagttcttttactgtcaacatttcttttggttgtctatccgttgtcaaaaggttgtcacctcagttgcttttttcttttagtatacatgaatttgatttgattatcgatttcttttaaggcgtcttaaaagtggtcatgtaaagtcctaacaccttaaattaaacgtgggacaaactttttattacgagggggtcgcatataggatctgagtgctatattaaaatatgcaaggatcaaaatagtctataggggcgggtatgctatactcatttatggcaactgccccgagagggggtgtaaatatgtttgagaccttgatatcactgattatcgcaccacttcttgtgggaatagtattaatactatttgatcgctggctagacgattagccgataatcgaagcagttgccttctggcaccaacgctgagtcgcaacagcgcaaaaaaaagccctcctattcgcagtaggagggctttttggtgtaaatatgctttgttcttgatatcacttcgcacgtttattatagcaaggaaggattaaaaaatcaaaatcaagaatcttaagtaactaaataccatcggcttcaaaggctcgatacaagagcgcattattcgtgtcaatgtattgttgtaaaatgtgtttgaagtcctccaaactatctttaagcatatcgacttctctattttgagataaaaaatttttcatatcatcttcaataatcatgttaattaattgattccttgagatttttttccctgaccgttcggacaattcttttgctcttctagtaagatacgttaatgtttcatcatgctcgaatcgaacaacaatttctttcatagtttcctccttcagtaagttcttaatcggaacttagatcattgattatagattgcaagtccgatagaatagctcgaaataaagaagagcataaggtagatacccccaccttctagttagaaggaggaaaataggctgtgcctattgggttttaagagatttcaaagtgatatcattacctcgtttttagtattctcacatgaatactaatacgactactcaggtagtcattttagctattttgactacttcatgactactttcaacattactttttcctttagaaaaaatacccgaacactattagttttttggaaggtattgagcaacaatttcgttgaaactgagtcctttttttgtatcttcttgtacgatattgttgtcttttgtttcttgattagtctgaatttttttcttattcttgaaccgataattttcatttcgcacagtttttttgctcattgatactgcctcttggtatacgttggaagaaaataaatcttgtattttggtgtgatcttgttccaattttgcgtttgtcattacggtcaaaacagacaatgaatctaatatttttttttcaaataattcttcttttcgtatgcgattaagcaaatcgattatgataaatcgcatcagcgcactatcatttattgtctcttcgacaggtaaataggttttcaattcttccaaagcgtccctatgttcaatgtcgatatatacttgtaatttttcctttgtcaaagaaattccttctttcctcacgttgtttttctactctttcattcgtcagataaagtcttcagctttcactttatccatcgattggtaaatatcgtaataagagttatctggcttcacactagattcggtcaataatttatgagccacttcttcaggtgaagaaggctctttgattttcgattccaacgttggcatttgatagtttgacgtagttgccttttgtgacgttggttttcttgtagtcgattctggaacgttttgtttccttggtgtcgcaattgattgatcaagccctcgacttggtgtttgtggcattgttttgttgccagtgttagcagccgattggctatttttttgtacgataccacttgtagaagtgccgtaaatcgttttaggtgtcgagctggttctnnnnagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgcaagttaaccttatatcaaatatttgatataaggtttttttttgtttaaaagtaacgggatcagcaatgagtctgccaaaaacatggtgcaaaaaatttaggtgacttaaaataactttttttgcgaaaaaatgatacactgtttatgaagagtttttaggagggatagtatgactgaggagcttaaaaaagaacaggatccagtagacaatgaacgtaacgaaacgacgtcggcagttccatttacagaaatcaaagaagtcgcttcaaaaaatattggtcagatgcttcaagacctgcaagcgttcgaaacagcgattgaaaaggaagacattccggagatttatcgaatctacaatggccgcctgcacaaagaattgaaagaaacatccaatcaaaatcatgaaatcgatgagttgctggcgcggaaaatccatgacagttttgtcgctacttttccattcatgatacatgccgatcgaatttcacctacggttcattattataaaataggtgaatactaccatgaacgtccgacaattggcattgatgccagtgttccagaaatctttgtgattcctgctattgatgatgagtggcgtaaatttcaacgcggcaatcgtgatatgctgacagccattgaacaacagatggataatttagacgccaaagccattgcggctcaatccgagattcaaaaactgcaagaggagatcgatcgcattaagcgtagtgaaaacgagttgtcagaatcaaaaggattttttaatcgcggaaaaatcgatgaggaattagaagcattagtccaagaacgaaaaaaagtagaagcgaaacaaaaagaatggtctcgctattcccaaaacgaacaagacgtgcttcttgaaaaagaacgattaatgcagcaatatcacgccttgcgcttaaaaaaggcaatcgtcgaaaaagaatttcgtcaaatcgatcactattttggttcgttgcaagagatgaacgaacgattgcaagctttcttaatgagctatctaggagaggagtcgatcgcagatgaataatgaggaagaaaaaacgcccctaatgaaagaacaaacagaagatgggattcgcgaaacagctacgtcaaagagcgaactggaaataatggaaacaaatgagtgggcaaccgccgctgatgaactaaaaacagttgaaatagaatcggatgagcttgaagcaacggcaattgatcaggaagacttgtaccaacaatctgctgaagaaggccatagcgaaaggctaatcattgactctacagagtctgcagagcttgaaatacctgaagcacctggagaacctggagaacctggagaacctggagaacctggagaaccttatgatgaatactatgaaacgaaagaaagcgatcaccaaagaattgaaagcttgattgaacaagcagaaattgaattagcagatttgcgcttacgcaaagccattatggaagctgattttgatgaattatgtcatcactaccaaacattgatcattggcaaccaggatatttcaattatcgcaaaaaagacgttactggaatactatgcttatgaattcttgaaacccttgcgatcgattggattgatgccaaccgacaactacgatgtttggaaaacaaagcacttcttggtgaagtttcaattgaatgaggaaaaagcaatggatttatattttaaattaaatccgatcaattctcaatatgaatcacagtacttgccgctactcacgatttattctgacacacgagaagtgcgggtcaacgaccatcaaatcttatatctattgcggcaatggtatacagataaaatatttacggtcaatcaattgtcactgtttaattacgatatcaatttactcttaactcattttcgcgcatcttcatttatggtttcaccaagtctcattgataatacgcaagaacttgcagtggatttagagactgagtttccgatcacaacagacattttggaccaaatctttattactacgatggaaaatcaaggctatgattttgtcaaagcagagtatgaagactatgagatcttcttagataaaaaacaacgcttgacgattcggatggctgatgatcggacccatttgtttattgattcagatcgaagaaaacgttccttgttagatttcttcacttcttacgaatttttagttccattagtagtacctagttattcgcattaaacaagcataagagctaaaataatcattaagattattttagctttttttaggagaggagaatgatgtaatgttgaatcgtgcgatcggattttatgagggaatgcctttagataacagcaatgtttttcaaacgaaagatttggacatgccttcaataggagcaaatgatctattgataaaagttgaagccgtatcggtcaatcccattgatgcgaagcgtcgccaaacgacgaccaaatctggtcatttcgtgatccaaggatatgatgcttgcggaatcattgaaaaagttggcgatcaggtcacagaatttcaagtgggcgacccggtgatgtacagtggaacaacacagcgagacggggcgaaccagaaatatcaagcggtggatgcacgcttagtagcgaaagtctctttagaaaatttagcggaatgggcagcattgcctttaacaagtatcactgcctgggaacttctatttgagaaatttgggttgattcctaaagaaaaagccaatcaaggaaaactattgatcatcaatgcaagtggtggagtgggatcgattgccgcccagctggcacattggtccgggcttgaagtatatggcactgccagccccacaaatcatgaatggctagataaaaatggggtagcgcacccactcgattaccattacccgctacaagatcaggttgaaaccacctttgactatattgctgtcttttatgacatttccgattacatcgatcaatttgctcaattgatccgcccatttggtaaaatcggaatgatcgttaatacgcgcggtccattagatcttaacccatttaaaaatatcggagtggacttttactgggaatatatgtttgcaaaaaccgattatcaagtggatttggctagtcaaggagcgatcttaaaaaaaattgttgatctagtcaatgaacaaaaaatccattctacgatcaccacctgttttgaaacaggcctgacgatcgaaaatttgattgaagcaaccgcattagtagaaaaaggcagtccagggaaggtagtcatctccggaggattccatgagtgaggaacaagaattttgggatgattttgcggcagaatatgcagagatccagcaagaatcacaattaacgattgctgaggatctagcaacatttttaaagacaaacggaattttgccaataagctcttttgttgatttagctgcgggaagtggccgctatattccagcgattttacctgatacaaagcgttatttggccattgatttttcagtggaaatgttgaaagcagctagacgttatgtaaaagatcctcaacaaaaagtagactttcgactgcaaacacaagcagagtttcttgctgataagaccacctatcccttgatatttactgcaatgaatccagcgttgaccgagaaagatcagctgatttctctggtagaaaaaagtcgtcgcttattgattttgcggatcgttcggaccaaagaaaatatctttcaaccactggaacagaacgatcacaaagatgaaaagctactttctgtctataagaaatggcttctggaagaacaaatcagtttttctactcatcttttttcttatgcttatgaagaaatcattgatcgggaatttttttaccgctattttcaacaggatattccacagtcagaattgctgcagctaagccattccctttttagagaaaagaaaaaagcaattagtaagacggagatcgattatgaactcctaatcgtttgaaggcaagcggttgtcctgtatattcagggacagctgcttgcctactagtgtctattagcctatccctaaatagagatagccgattgaaccgattatgaataagtaaaggatattcaccatatagaacttgtgttggaatcttttttgttcttgagggagagcttgcttgatcaatttgtaaccaatcaaattcgctaacgaagcaatcaatgtgcccaagccacccacatttacccccaacaaaacagctttcttgtaggttgtaaaaggagcaatcagaatcgctgctgggacattggaaatcacctgagaaagggtgatgctgcctaaaaaggcttgttgttctttttggaagaagggttggatcatttcaatcaacttgtcttgttcgttgatatttccgataatcacaaagaaacaagcgaatgtgactaagagacggtaatccactgaacgaaagagctctttttgaaaaaaatagaccacgaatgctacgatcgatgccgagaggacgaaaggaacgacatgaaagattcccaaaatcatcagtgccattaaaccaagataaagtaccatgtattttttctcaaaaaaatgcgtggtttttttgatgatgagaggggatgctggcaataattgaatggatcctactaacagagttaatgataggacaaccatcatacctgtcgtttgcaaaaaagtagtcaaaggtaaattataaaaagaaaacaagaagagattttgcggattcccaaagggaaataaactgctgcctaaattagcggctacaatcaggtaaactgcgccgagaagaacgcttttttgttcctgaatgcctttggtgatcagaagatacataggtagtaaagtcaggatcgccacatcgttcgttagtaccatcgagctgaaaaaacttaataaaacaatcgttcgaatcagtgctcggagagaatgactcttagagagcaaacgttgaccaatgaaattcaacaaaccggctttttcaagcccattaatagtcagcatgagaccaaacaaggtcaaaatcacttgaaaatcaataaagtggacatcaaaacgtccaaatgaactcgcaacaagcgccaaaaagaaagaaatcgaaaataataaatcgctttggaaaaagaagaatattttttttaacatgcgtgctcctttctttcaaattttaccatggactcttttagagaagcaaagaaatattctcggttttgacatatactgtgaaatcctatcgctcaatatggttgacaaacgaagcgtttattgggaaattagaactagactgaaaaaggagcagaatcgatgaatttgatgcaactattagaaaaaaatcagcaagtccattttcagatattgaccatcttctttcagcatggttcagaaatttcctataaaactcttgcaaataagttatccatttcttcaccgacgctccaaaaggagattcagcatttgagtgacaatctttctgttttccatgcagaggcattgttagaaacaaaagagaatgatcgtttgcatttaacattaccgcttgatttttctattcagcattttttttatgcgtatttatcagaagcggtggattttcaaattattgaatatctctttttccatcgcgaaggatcgacaacgaaactcatgttggatttgacgcttagcgaggcctcgctttttcgtcatttcaaatcgatcaatcacttgttggaggaatttagtcttcaattgaaaaataagaaactgatcggcgatgagcgccaaatccgctttttcttttattcgtttttttcgcagagttatccgttagcaaaaatcaatgaaacctttaagagtccagctattcgaaacttgattcgggtgattgaacagcaactcggcttatcaattgatccacggaataattggaaattggtcttatggtttggtttgatggaagcccgtttcgattttaggagttcccagcaacatgagtcatcgaaaggcctcttaaaacaagtagaaaatgatcctacttttcaagtgctacgaaatattttaggacgttatctcagccgttttgccatttcgtggagtgactacgaagctgtttacctctatttgtttttgatgatggaaggattagtagtcatggatcaccagcaggacactgattcggaatttatgctagatttagccgctgagagtcaagtattgatgaaaacttttgcggatgaatctcttgatatacaagttcattatccagaaatcagtcgttttttagcaatcatcgttcttagagcacgctacttgaagggctcgttgacttcatttgccgattttcctccgcattttttgcggggaaccatcacggaagtagcgaatcaagcagttgaaacattggcacaagccactgggcctttttctgaggagaaacagagaaagctcatccatgatttgtcgtttgttattgaatggttgcaagagaaacaacaaaaagagctgaaaatcggtgttctgctgtctcaaaatcaattacgtacggatgttttgcggcggtttttggccaaacagctctctgggtatccttacatgcaggtggaaactgcacaagcaaccgattatgatctgctgattgtggatcaaccgcagattgccgaaaactatcactacaaaaagctcctggtcttgacaggtgtgatcgatcgttttgaagagcaacggctgcatcaagtgattgatgaaattcgaagggaaaatcttgaaagtgagttggagaagttatgaggattgtcattattggaggctctcatgctggtatagcagcagcccgccatttaaaacagatggatgataaaattgaagtgatcatcattgaaaaatccaatgtattgggctatatcgctagcagtttgaacttagtattagagggatatattgagcgtctagaagattcccgcactgctactgccagtgaattactgtcagaagggatcaatgtgatgctcaatagccgcgtcgtaaagattgcagcggcagaaaaaaacgtttcttttgaaacatcaacggctagttgtgtcgaaaaagacacgatctcatatgattatttgattttagctatggggtccagtaattttcggaatgcttttacggaagaagtcaaagagcacattaccacgtacaaaacgattgcccagtctcgagcagctctaagcaaaatacaggaagccaagaaagtggccattgtgggtgccggtctgataggttttgaattagcggaatcactaagtggacaggataaagaggtcttcttgattgatcggatggatactttgcttttccgctacttcgaccaagagatttctcagattttgatcgaacgttttccagaaaatttacaaatctatctgaacagcagcgtggtcgcagcaaaacaaactacgaacggagagctggcgggaattgaacttgccaatggcacttttttgccagcggatatcgttgtctatgcagtcaatccaagaccgaatgttgacctggttgctgactttctgaagttgaacccagatgggacgatcgacaccaatgaattcttgcaaacttccgatccaagcatttatgctgtcggcgacttagtctcgatcccattcaatcattcagacagttcactctatgtaccgctggtgaccaatgcgtatagaaccggtatcgtcgcggcaacaaatattttgtctgcaaaaaaaatcccttttcccaaaatgcagcgcacagtggtcagcaagctctttggatattttgtgagcagctctggaatcaatgaaacggaagcaccttattatggctttgacgtcgattctgtcacacgtacgttccatgcacgtacgtttttcgaagtagaaaataattttgaagtgacattgaaactggtatttgacaaggaaacacgagtaatcatgggagggcagatcattacaagcgatcgcggcagtttggagatcatcaatacggtctctacgttgatcacatcttacatgactcttgatcaattggctacgatggattactttttcaatccaacgatatcttttccgctgcactttttgaatcaattggccatcgaaggtctcttgaaatctcacgtgaattaaatgtgttatatattaaaagtttttttattcgataaacctacgttaagagtaggtttatctttttttttgcaaaaagccttgtcattaaaagtggaatcgcttaaactaactagagagaatgagaatcgttctcattagaaagggttagtatatgagaaaaatgagtctggccattttgcttctcttgttgatcactgggtctttatttgtgggcgcacatgacatgtctctagctggtttaatggcaggagaagagagtcattggatgatattgctgaaagtacgcgttcctcgtacgattagtctcttgcttgcaggggctgtcatgagcttatgtggaaaaatcattcagcatctgatgcaaaataaatttgttgcagcagacgtgatcggtttgactgacagtgcccgccttgggatcttgatcgtcatgttatggctgcccaatgcatctggactcctgcgaacaaccgctgctttcttattttcttatgcgggggttttgctatttttatggctaagtcgcttgatccctaagaaagatccgatggttttgcctttaacgggtgtgatgttcgggaatgtgattggcgcagtcagttcctttcttgcgtaccgctttcaacttgtgcaaaatgtttcttcctggttacaggggaactttgctaccgtgatcgagggcaattatgaattgatttatctgacactaccaatttttgctcttttgtatttccttgcctatgaaataacgattgccgggttaggagagacagctgcaaaaaatcttggcatcaactaccacgttttacgcttgctcgtatttgcactggttgcttttgccagtagtgtggtcttgcttttagtaggcagtgttccattccttggtgtgatcatccctaatatcgttgctttatttgcaggagaccatgttcgaaacaacctttttctgatcagtttttccggcagtgcctttttgctcttgtgtgatttgctagcaaggattttaatagccccatatgaattgccggtcagcgttgtagcaggaacgattggcggtattagctttctagtcttattgatgaggagaaaaatggtatgagaattatccggcgttatatgttcttgttcatactcatcgggatagctgttggcgcataccttacctacaatacatatggcaattggtccttcgcactgcaattacggggaaagcgaatagtggcctttggcttagtagcaatagctgtctcgtttagcacgatcactttacaaacactgacacaaaatcggtatctgactcccggtatcttaggattggatcaattatatgtgctgatccagacgatactatttttcttcttaggaggaatccgcatgttgagtcaggaaacacctttcgtttttttgttttcgattttagctaccgggacattaagcagtgtcatcattcagaccttttataaaaaagccaataatcaattgtttctattactgatggcgggaatgatcagcggtactatgttcactagtatcagttcatttcttcaagtcatcatggatcccaatgaatatgatttgttgcaagggcgtctatttgcaagttttagcaatgtcaatagtcagcatttattactggctgctggaattattttaattgggctgattggattatcgctattgattccagaattgaatgttatggtcttgggtgttcgaaatgcaaaaagtttaggcctatcggtttcaatgatccagaagagttgtcttttcttgctgtctttattatcggggactgctactgctttagtaggaccatccgtctttttaggatttgtcgtggcaacgattgcctatcagttatttccaacatataaacatggcacattgtttgttggatcagcacttttagggtttttattactagtcggcggccaattttttgttgagcaagtctttcaatggaacacaacgatcaatacagtgattcaatttttaggcggaatcttctttttaggaaaactagtcaaagaaaggaaaggacaatgattgaaacaaaaggaatcgaaaagagttatcaagacaagcgcgtgttgactgatttgtccttgcagttgccggaaaatcaattgattgcctttattggtccaaatggtgccggaaaaagtacattgctttcgattatcagccgcatgttggagcagactactggagaagtttatttcaaagaaaaggagattcgacaatggcgttcgaaagaattagctaagaatctcgcttttttgcaacagagtaacggttttacggttgatatgaccgtagaagaactggtgtcttttggtcggtttccctataatcggggacgatcaacgccagaagatgaacaaatcatttcagaatcattaacacttttatctttagaatcatttcggcaacgctcgatccatgcattatctggtgggcagcttcaacgggtctatttggcgatgattcttgcccaagataccgagtatatccttttggatgaaccgctgaataatttggatttgaaacatgccaatcagttgatgcacttattggagaaattagtcaaagatcatgggaaaaccgtattgatcgtattgcatgacatcaactttgctgccagatatgcagaccatatcgtagcgatgaaagaaggaagtttgttcaaaacaggcacagttgcagaagtgatccaagagcctgttttaaaagaactttatgacttagaagttaagatagtcgaagtggatggacagcgcttttgttattattttaattaagagaccataggaggagtatatgaaaaaaatagtatttagtttggctgtattggtaatgatcacggggttagcaggatgcggctctcaagaaaaaggagagtcaacaagtgcctcaacggctgcagcggcgcctgccgaaatcgaagtgacagatagtaatggcaaagtgactgtgccattttcaccaaaaaaagtcgttgttttcgataacagtgcacttgatacaatggatgctttaggcgtaggagatcgtgttgtaggagctgctacgagcaatatgcctgactatttaaagagttatgctgcggttgattctgcaggtggtatcaaagaacctgacttagaaaaaatcaatcagatccaacctgatttgatcattatctctggccgccaaagagactttcaaaaagatctggaagcaattgcaccaacgatttttctaagtgtagacaacgaaaacacttggtcatcgatcgataacaacattcaaactattgcccaaatcttcggaaaagaagaggaagccaagaaacagttgactgctctgcaaacaagaatcgcgaatctttctgaaactgcagaagccagcaaggaaaaagcattagttgtcatgatgaatgaaggtagtctttctgcctttggtttgggatcaagatatagcattgtttatgatacatttgggtttacgccagtcgatgatacattagaagcatcgactcatgggcagaatatttcttatgaatatttactggaaaaaaatcccgatattatttttgttattgatcgtacaaaagcaatcggtggggatacaagccagagtacgttgactgaaaatgaattggttcagcaaacaactgctggaaaaaacgggaaagtgatcgaattaaatccgcaagtttggtatttagcaggatctgggatcgaatcattggacattatgttgtctgatgttgaaccggctgttgcaaaagattaaaggcttgttatcggataaggatggcttaaatgagaaacagttgcgaatgttggatgttcgcaactgtttttgtattgaaaacaatttattcaatttaaaccaaatttagtttttttcaggtatgctaggttcaaagggaaggagcggattccgaaatgcacaaatatttgctggcggctgccttaggtttagtactgttaatagggggattatttcttcgggtaaacctgatcccgatcgcagactttgagctattgactttggcagaaaaaattacattacaaacagaggtggggctcgcgccaaagtgggggacagtcttaatgggcagcggattagctattttgttgttggttttcatttcctattattggccctccaaaccggggcacaaaaactatttggtcggtgcgggtttacttgcgctttggataatctgcgtaaagatgatttttttcccgcctcaaaaggaatgggtcgaagggacggtcatgaaagtctatgaggatgggtatgcatgttttcagacgaagaaaaacgcggaatcacgttattcatcagattttggtctgtattatttcgaaagcagcgacagttggcagcttcgagaaggacagcagatcaaagttttaacagaaggtgggagtttcataaaatttgatgaagtgtttttaccggtaattgatgttcaaccgttagcggatgtttctcggtctcaagactgaattaaaaaaagaatcacagatttactttacctgtcgtagtaattgatttataattattacgacaggtaaagtaattttaaggaggggatcgagtgatatccagcgatggaattcggggatacaatgatgcaatcatcttatcgattctttccaaagatgattcctatggatacgacatttcaaaacagatacgtgaaaaaacagattcgctctatatcattaaggaaacaacattgtattctgcattcacacgtttggaaaaacaaggattgatccgctcgtatcctggagaagtgactcatggaaagaaacgcacctattatcaaatcagtgaggcaggaagagaatttttagaagtaaaaaaacaagagtggcagcaaacaaaaattgttgttgagcgctttttacaaggaggagcaaaatgaaaaccatccgggattatttagatagtttgtttttgaatgtacccaccacgccagaaacaaagaaagccaaagaggatttggctgcgatcatggaagaccattaccatgaattgattgaacaaggaaaaagcgagcatgaagcaatcggggctgtgatcagtgaatttggatcaattgatgagttgcttcaagaactgcaagtagcgcagtcagaagatactgcagaagaagcctggttagatgctattacaatcgatgaagcctttgatttttgggggaagattcgccgttttgccttctcactttctttaggtattgcgttatgtatcgcttctcttggaatatttctcttttttgccaatgaaatcgatagtggcttaggactattagtcatgttcatgtttgttgcattgggcgtgggctttattattacctccggcttgaactattctgcatcaaaacgaaaattaaacgatcgtccatttgatcaagaagtaaaacaagaggcgcggaagcaattggaagattatgaaaagagttttcgatttggtctggtgctagggatttctgcatgtattctgtcggtgacaccctttttcttgatggaagctattctttacattcccagtggtttagctttaggactgttttttgcggcagttgcattaggagtattctttatcgtctatgtcagtatcatccgcacaggatttgccaaaatggccgatggcgtttactttatttctaatgaagatgaacccggaccacgggcagcgcaacacatttatggagaatccgcaggaaaagttcgcttttttaatacggtttattggccagtgatccttgtggtttacttcctctggtcattttcaacaggaagctgggcctattcatgggtaatcttcatcttgggtggggtttttcaagatttctttttgcctcatcagaaaaataagcgctaaggaatttcttgaaatagtttttgataaacatctgaaagatccgaggttctgctagagcagaagaggagtccttcaggtgtttttcttatcggtttggacaaataaaaacttttcactttgatgaatttgacaaagtgaaaagtgacttaaagttattgagaaaatatccttgtaaatgagaatgagtagccttgagggtataattgttagaaaagtgaatctatttattttcccagaaatcattttaaaatgaaagtgaaacgctcatttatgaggagaaattcattttgtttaaaaaaatgcaaagagactattgcaattccactggctttagactaataattaagagagattattctcaaataataattctaattggaggaatcgctatgtcattaattggaaaagaaattgagtcatttgaagcacaagcttatcacaacggaaaatttatcgacgtttcatctgaagatttcaaaggaaaatggaatgtggtttgtttttacccagcagatttttcatttgtatgtccaacggaattagaagatctacaaggtcaatatgcagcattgaaagaactaggaactgaagtttattctgtttcgacagatactcactatacccacaaagcatggcatgatcactctgatgcaatcagcaagatcgaatacattatggttgctgacccttctcacacgatctctcgtatttttgatgtactggatgaagaaagtggcctttcgcaacgaggtacttttattatcgatcctgatggcgttgttcaaacggttgaaatcaatgcggatggaattggacgcgatgctagtggattgatcgacaaaattcgtgctgcccaatacgtgcggacacatccaggtgaagtttgcccagctaaatggaaagaaggagaagacaccttaacaccaagtcttgatctagttggaaaaatataggaggttgacatggctttagataatggaattaaagaacaactgaaacagtatctggcaatgctggaatctgaaattgttttcgcagctagtcttggtacagatgacgcctcacaaaaagttcgtgatttcttagaagaaatcgcagaaatgtccgaacgtattacgatcgaagaagtaactgcagatcggacacccagctttacaattatgcaaccaggtatcgacagtggcattgcttttgcaggtcttccactcgggcatgagtttacttcatttattttagctttattgcaagttagtggccgggcgccaaaggtcgaacaagcgattcaagaccgtatcaaacaaatctctcagcctttgcattttgagacatatgttagtctgacgtgccataattgtccggatgtcgtacaggcgttgaatatcatggctgtcttgaatccgaatatcagtcatacgatgatcgaaggtggtatgttcaaagcggaagtagatgccaaaaaaattatggccgtaccaaccgtctttttgaacggggaagaattcgctagcggtcgtcagacgatcgaacaattacttgaacaagctgctggtccgactagcaaagactcgtttgcagataaagatctgtttgacgtgttggtcgtagggggcggtccagcgggtgcaagtgctgctgtctacgctgcccgtaaagggatcaatacaggcatggtggtggaaactttcggtggtcaagtgatggaaacattaggaatcgaaaacatgatcggtacaccttacacagaaggaccaaaattaatgcgtcaagtggaagaacatgtcaatgagtataatgtagatgtcatgaaaggacaacgtgccaaagatatccgcaaaaatgaattcgtggaagtggaattagagaatggtgctgttttgaaaacaaagacagcgatccttgccactggtgcacggtggcggaacattaacgttccgggagagcaagagtttaaaaataaaggggttgcttattgccctcactgcgatggtccgttgtttgctggtaaagaagtggcagttattggtggcggtaattctggtattgaagcagcgattgatttggcaggtatggcaaaacatgtctatgtattggagttcttgccggaattaaaagcagaccttgttttacaaaaacgactagcaacattggaaaacgtgacggtcatcaccaatgctgctaccaaggaaattgcgggttccgatcatgtggagcagctgacttatgtggatcggcagacaaatcgtgaagccactttagctgtggaaggcgtctttattttgattggcttgatgccgaatacagaatggctgaaagatcgagtggctttgaatgaacgcaatgaaatcattgtcgacaaacatggaactacagatcttgctggagtttttgctgccggagattgtacagacagtgcctacaagcaaattattatttcgatgggttcaggagcaacagcagcgttaggcgcatttgattatttgattcgccaataatcaaatgcggactgatcctttaaataggtacaaggaatgactgcaacgccgtttaccaatttgattcatttttgatccatgatcattgcagctgatggctgaacttcagtcaaatagttgccagttgattgggtctcgatggatcgatggcaaatggctgttgcagtttttttgtcctgaaaataacgagaaatctctaactaaaaaaggcagcgattcaatgagctgtgagaaaacaggggaattagtcaattgcttaaagatgtttaagaataattaaagaaaaacacaaaattgcggaattcagttgtcatcatgaggaacaaaaggtaacattcaggatgaataaaaataacggataaccttgttaggtgaggctcctatacaaacataagctattgcgcagaaacgtcgaaagacgccaatgtgtaaaacaggaattgtcggattaaggctcttcataaaatagctaagaagaaataaatactactaatttgcttcttctttacgttgtatagtgccaaaactcggacgatgagattgcttgcgaagtcgaacgtcttgagagaagtttggctttttttcttttcttgagtatgtttcaaaacgtaaatggataaaataaataacgtctgaaatcacctgctccaagggaaggagtggacgatatgagtaaaaagagaaagatcgattggttacttatcacagcttatttgctgttgagtatcatcggtcttttaatgatttatagtgcaagttcttaccggttgatgactgctgggggtgcaccggccgcgttgttccagcgacaactgatttttctgctgttgagttggggaatgattcttttgattcaaaaaacccgcgtcgaaattttgttaagcaaaaagttagctgtgggactattggcctttggcattgtcatgttactgttggcctacctgccatttttcggggtatcagttaacggtgctcagcgctggatttcgatttttggcattcagtttcagccttcagaaataacaaatgtcggtatgattctttatttggcaaactattttaaggacaaacgatctttcaatgaattaaaaaagccgctctttctcttatttctatgttgtgggctggttctaatgcagcctaaagttgcaggagtaatgattttactatttttggcttttgttatgatcacgactgttcaagtgccagtcaaagtcacattcctgctatttactgcactgatttccagtttatttcttttaggaggtgcggtcctctttttaggacaacacggctggttaccacaatacttcatgcatgtatacaaccggatccaacttgttggagatccattttctgacccatatggtcaaggtttccaaatgattcattcctattatgcattattcaatggcggattaagcgggttgggtttaggcaatagcatcacgaaaaaagggttcttacccgttgcggagacagacttcattttttcggtattggtagaggagcttggccttttggtagggatttttgtaattggattattatttctaattgtgttgcgcctgtttattcgttcggcaacagctattgattcacaaataggcttgattctattaggaactgccacattgttgttattgcaaacaagtatcaacatcgcaagtatcttagggttaatgcctatgacaggggttcctttaccatttattagttatggtggctccagttactttattctttcgtttgcttttggtatttgcctcaaattggaaagagggagggaagcaaatgaagtacttcaaacgacatgaagtgaattatgcactgattctaccggttttcttactttttttattgagtattgcggttcaatatggtgccagtgtgctggatggcattgatccgggaccggttgttgtgcggcaactctttttttgcatcattgccgcaatcgcattgtttgcgggcagtttactttcgacgacttttttattgcggttctctggcatcttttatgttctttctctaggattgatgacattattgtactggttttatgatcccgtcatgtttgagttgacccatacaaaacgttggatccgaatcggccgtttcacattgcagccttctgagattatgaaattggcttttgtattgtttatggtgtatctcacactcttatatgaaaaaagacagattcagcgaacaatcaaatctgactgtttctacattctaaaaatagtgctttatagtttgccgacttttctattgatgtatatgcaacgggactttggtactagtttggttttcatcgtaatgctcggcgcactatttgttatttccggtgtccattggaaactgttgacagtaatttttacggtattggctgtggttggcggactgttattgctattagtctttactgattgggggaatacgatgttgtttcgattgcattttaaaccctatcaattggatcgagtcaaagcttgggcagatccttttgcttatcaagactcgattgcttaccaacaagtacaaagtatgtgggcaattggttcaggtggtctcctcggggcaagtgacacgcacattcctgtctacgttcctgtgcgtgaatccgatatgatctttacagtcatcggagaatcatttggatttttaggcagttcattagtaatttttctctatttttatttgatttatcagatcatttttgcagcattgcggacaaataataaagcctcggtctatctatcgatcacgtttgtttttggtttggtttttcaaatttttgaaaatatcggggcggcgattggattactgcctttgacgggtattccactaccatttctgagtcaaggtgggacctcgctgattgcagttggtctctctttaggcattatttttgggctggagaaggcgtatgccccgaaaaaaactttcccaataaattaaaggagtttactaaaatgttcaatcgaactcatcggatgacggtcagtcttagctttattgcattgttttttttattgacgatcctagtcttgcatcagccacactggtttcaaaggatagaccgactcttttggaatttgcctcagatgcgcactgctttaggagaccaaatcatgttgggcatcgcttcgactgctacgatcctaccaataactggtttatttctgcttttgggcatctatttatggaaaaagcagcaacgagtttgggcaatctggggaataggaaatctgattgtagtgagtggtatcggtcaagtgatgaaatggctgattcagcggccacgcccagtcctagaagctgggatggttcgcgattcacacagctttcccagtggccataccctgctagctgttacactggtgactacctgtttgcttttcactcgatttttgtttaagaaaaaaggtctgttggctatcctcggcggctctttcatttttttagtaatattttcccgcttttatttaggcgttcattacccaagcgataccctcgcaagtatctgtttagcaagtgggatcacattgatgacttatgaatggactgaaaggattcttacgagtaaaagtaacaatttatccgataaattcaagcaaaggagaagaccatgacgaatggaaagaaagtttggctgacgcttttggttagtttaacactgcttgtgaccgttggaacagtctatgcgctgcgcatcgttcttcgtgcagaacaaacggttcaaaccatgcacgcaccgattaaagggcgagaagcaacagtaattgaagaggtagaacccctaagtctgctccttttgggtatcgcaaatgattccaagcgaaaaacagactatcgtgcgaacacgatcatgatcgtgacattgaatccaaaaaataagcggacatccattacaagtattcctcgtgatgcttatgtagagattgttggtaaaggtttcaaagataaaatcaatcatgcccactcatttgggggcgccgaaatgatgatcgcttcgatcgaacaatttttacagatcccaattcatcattatttctcgatcaatatggatggcatggtagatcttgtagatgcgattggcggaatcacagtttacaacgattttgagtttacggctgagaaaattcattacccagagggggagcttcaattagatggttgggcagcacttcagtatactcggatgcgtaaagatgatccagaaggggattatggccggcagagacgacaacgacaagtgactgagctcctcgctaaagaattgctgtctctgtcaagtttgttccagtaccaagagctcatgtcgatcgttggagaaaacggccaaacggatctcacttttcagcagatctcacgattaataacgagttaccagtctaccctaacaacagttgatctctatcaaatacaggggacaggctttacgggagatggattgcaaggagaagcagggatttcttaccaagcaatctctgatgaggaacgacagctagtgatccagcgattacattctgaattggatatgcaaacacataatgaaccggcagaatagatgatgttgacaattcgatcatagatatactaaaataaagaaaatcgttcaaaaaaagaaagaggtctcttgatgagtgtcttaggtatctaaccagcaaatttaaacaaataaacaatactaagtttatttgttgtgcctgcagataccgatcaaaatcgttattgataaaaacaggtgatggggaactgtcaccttttttgtacactttttttgaacgtggaggagagacgtttcacgggcacaagaaaggacctcatatgaatatcccacaagaaactgaatttgacgcaattaaaacaactgttagtcaacgaatccttagtgattatggcaagcaacgatttgccgaacaacaaccggcctcttctattcattccgctagaaaaagactagcggagacaaaagaagcaatggccctcttaggctctgggcaacaagtaccattcatgggcctgtctgatattttgcatcatacgacaaaaatcgaaaaaggcttgattttagagccgagagaattgatcgattatggagactttttacggtcttttcgattgatccgtcagatgtttgaaaaaaaccagtggcagacaccgcggcttactggctatgcgcaaggattaacggatttttcagacaccgcacaaacaatttttgacaaaatccgaaatggccggattgacaccgatgccagtcgtgaacttaggaaaatccggggacaaatagccaagcatgaagcagaattgaaaaaagtcttttcaaagtttttgcaagatccacgactattacaagatgcacgaatcattcaaaaaaatgatcgctacacactacctgtgcgctccgaatttcaacatcagatcaaagggcagattattgaacgctccaataaacgggcaacagttttcattgaaccagaagcagcgattcgcttgaacgatcgcttgataatggccaaagcagaggagactgccgaggagtatcaaattttagctggattgactggactgcttgcagaaaacttaacagaaatttttacctgtctggatgtattggttgaattggacatcatctttgctcgagcaaaatactgtcgtgaaattcatggtgttccgctagaaatcaatgaagcagaagtaatcgacttacaggaagttcgacacccattgttaggagcagcagcagttcctctgtcattacaacttggttacgatgctcgctgtctggtgatcacaggtcccaatgccggtgggaagacggtggtgttaaaaactgtggcactggtttgtgtgatggcgcactatggtctctttccttcacatgctgggggaagtcaggttccatttttgaaaaatctgtggatggatattggggatcaacaaagtttagcgaacgcattaagtaccttttcgggacatatgaacaacattgcccaaatcgtcaagcatgcttcacggcaaagcattgtattgctggatgagatcggcagcggaacagagccaaatgaaggagctgctttagcgattgcgatcatggaagccatctatcattcaggtgcgcttttgattgctactacccactatggggaaatcaaacagtttgctattgatcatcaagatttccatacggctgcaatggcttttgatccagaaacattgacacctaaatatcggctgctttctgatgctgtgggtaccagtaatgccttttggatcgcagaaaagatgtcagtctctaaagaaatcgttgctaaagcacaacgatacttagaaacgaaacagtatccaacggaaaaagcagtatttaaaggcatccagaaagaacgacagcaagtatccgtggctactttaaaaaaaggcgatcgcatctcttacacagagacaaatcaaacgggcttgttttatgcctatttagaaagcaatcaagcacagattttgctggatgaatcattggttatcgttcccactagaagagtcaagcttctgatgtctagagaagaattatatccagcagggtatgacttggagagtctgttccattcatttgcagaacgcaaatttaaccgagatatcgaccgtggatcgaagaaagcgcaaaagaaattaagaaaacaagcacaggaaaggcaagcatttgcgaaaggcgacggcgcgcaaacgtaattgatcgcaggaaataagctagcgaagataactttcagtaaaaatcaagctattttgcaacaatacgcaagtgtttccaataatggtagaaatagcgctagaaatgcaataaatatataggatgctcacagcaaaggtccgaaagaggggaaagagatgatagaaacaacgcgtttaattttaagacattggcagaattctgatgccaaagagttgtttgagttggcaaaagatcctgctatcggcccaagagccggctggtcgccgcatcaatctgtggcagaaagcgaaacaattattacggatgtttttaacacgaatgaaacgacttatgctatttgtctgaaagatggcatgccgattggcagtattggtattatgccaatcagcaaagaatttatgctcccgcctgcagttgaagtaggctactggatcgggaaagcttactggggacaaggctatacagtggaggcgttgactgcgatccttgctgatcagtttgccagggaaccgaagctaacggtttgggcaggctattatgatggtaatgaacaatcttggcgcgtccaacagaaatgcggttttgtctatcagttaactcaaacagtcgaggttcctctgttaaatgaacaaagaaaagaacactttactagcctcacgtataaccaatggctagctgtctcagagaacggccaaggaacagcaattcaaaagaaagaaaacaattcatcaacgattcactatagcaaacaccttccagaggacccacaacaaatcctttcgttgtatcaagatgctggctggtccttgtatattcgcgaaccagaagtcttgtgggcagcacttcagcaatcccacatgatcactgcttggcagcaagagcgcttagttggtttggtgcgaggaataacggatcagcaaacgattttgtatatccaagatttactcgtattgaaagaattccagcggcagggaatcgggcaaacgttactaaaaaaaatagtaggagactacccgaaaattcgtcaaaaaattttattaactgacgatacgaaaaaaacgcgggctttctacgaagcttgcgggttccaaacagtggagaaaagtcatgcggtcgcctttttatatgccgctaacaaagttagtgaaggtctatcttcctaataaataataggaaaagaagtaggaaagtaaacagggaagtaagtaggtaaataagtaagaaaagaagtaggaaaaactagtggcataagtcttaaccaagaagacacactcgatcactaaagaagccgtcctctggatgtcgtcttataatggctgatcttgactgttgtgatcgaaggtttatcagactgatgccactagtttttttgatcgtagcaaggacttgtctctagcaaacctcttgtttcatttttctagcgggaactcagaaaacgtcaaatttaataacattaatgaaataattttattgaaattttgtttttgtgacaaaaaaatcggttaagacatagtgaatatgctaaactagtaatgattgtttaacaaaaaaacaggaggtttttctttggagctattaaaaaagtcgaaattatttgcagtacttgtgtttatttgtttggtgggactaggcatatggatctattcaaatattctgtttgtcttccgcccgctagaagccatttttgctagtgtctttttacccgttttgatttctgtatttattttttatatctttttgccttttttcaatttgatcaaaaaaaggagcagcaatcaacatctcgctctttatgtcacattgcttctgatcctctttgctgcttatttaatcattcaggtgatcggtccggcactgattaacgaaatggcacgttttatcaatcagattccttacatcatcaacagaatcattgacaatatcgatcattcttcttttgaggaattatttggtccactgttagattcattggatatcaaccaaatcagtaatctcgctgctcagtttatcactggggctacgaatagtctgacaagtttggtagcaatcgtctctcattcagcgattgttttgttcacgattccgttgctattggtttatatgtttaaagatggacataaggttcctgatcttttggtctcgaaagcaccaaaaaaaattcgctctcttattctgcagttgtgtcaagattttcatcaagctgcttcagcatatattagcggaaagctacttgtctgtttgtatgttggcgtcttcagctatctaatctttacatttttaggcttgcaaaatgccttgttactaggcttaatctgtggtgttctagatatcattccgtattttggtccttttatcggcgcggcaccagcattcttgtttgctctgagtcaagatatgaaaacagcagtcttgttagttattggcattacgatcattcaatttggcgagtcgtatgttgtttcaccaatcgtcatgaataaagtgctacatatccatcctatcattgccgtcttcttattattgatcgccgggaatttattaggatttgtaggaatgatcgttgcgctgccggtctattcgatcgtgatggccatggcaggcactttgacccgctattatcaacagcaaaaacatgtaaagcaagaaggaaaagaaaatgaaaatcgttgaatatgcaggggacaaagaagattttgtactagcaaaaataatacggacctcttttgatgcagataccgcatgccatttgggggcagacaaacgagacggtccatctggctatcataatggagaattattgaaacgagtgaagcaagatccagatctcagtctttacctgctgcaagaaaatggcattattggtttgattgtggcaaatcctagtaaacaccagatttgctacttttgtctcgaccctgattttattggtaaaggggttgggactcttgcttggcaattatttgaaaaacgatttcccgtcgattactggatactagaaacaccagcatattcccttagaaaccagcgtttttacgaaaaaaatggctttaaaaaaattggtgaaaaatggtatagtaaagacctatcctatatctaccaaaaaaaattttgataaaatcgcaaagtgagggaaggctatcatgaaagtcttatggaatgaagagatcgttgatcgacaagaggttcaaatcgatatcgaagaccgcggctaccagtatggagacggaatctacgaagttattcgcatttatcaagggaaaatgttcatggccgaagagcacttgcagcgactagagaacagtgccgctaaaataaaaatgacattgccttatgaaaccaccattctcaaagacagattacgttcattgatcgacattgagggaatcactgacggagaagtgtatttgcaagtgacaagaggggttttaagtccgcgaaatcatgtttttcctcctcaagggacgataaaaagtgtccttactgcaaatgttattccattccatcgtccagtggacatgcagcgtaatggtcttcaagccacattaatccctgaccagcgttggcttcattgtgacatcaaatcattaagccttttggggaatctgctctctttagaggaggctcggtccaatggttatgatgaagcactactgcatcgagagggcttttttacggaagcttccgcttcaaatttatggtttgtttccaaaggaacggtgtatacgcatccggatggcaatctggttttacctgggatcacaaaaatgaaagttttaagcttgtgtcaggaattgaagctaccagttaaggaagaagccgttgcgattgatcgattagcagaatttgatgagtgttttattaccaattctgtctgggaaatcgtgccaattgttggtatcgatggtcatccggtgggaactggacagctaggagctgtgactgctaaactacaacaagcgtatattgaagcaaccaaaaagaactgactccaaacaatacacccacctgagatagaaatccccctaagagttagctgactagcgacctcttagggggattttaccatttagtagatgttagttgaaataggaatcagagacgtgctagcagaacacttagttttttcaagtttctgtttcattcagccacgtcgtttactgtgcttagcaatcaattgttgggcgtttcatgttgtcaaaaatggtcttaccagtcttggggattccataatttactgtccaactcgccttgcttcagttgaattcgtgtttgttgttgtgtcaaaagcacttctaattcttgcaagaaggctttctcatgataattgagtgtctcctcggtttgttcttcaatcaaggagtggatccatgcctcattcattcgtaagcctccatttcagcaagagcttcatctaattcaagtaaggtttcctgattttggataagttgatcgagaagaggagcgagttttggattttcagctgtcagtgcttctagtctttgaataaaccactgttgtttggcagcaaatgaaaagggggcttccattgtcagcagctgctgatagtcgatcacaaatcgccgtttctctttttctgttttatacattaactgatcgagaacgagaaccggtaagatggtcatttggtatttttgtgccattaaagttagaggtcgcaaaatttcagaaaaactggctccttcttttccacctagttgaaattctttggctgcaacgcctgtagaaagagcaaagccgatttctttatttaataagtagggtttggctgcctcccaaaccgtatcgatccaacatttcatttttgcaggaacttggtaccaataaagggggaactggaaaatcagacgatcgatcgtttgcaatcgttctaactcaatctctaaatcaaaatcccccgcaactttgtcaagcatatgaacactgacattaggcatcttggcactttcgctaaaaaaacgttgagataaagagtcgtcataggacggatgactggcaataactaatgttctaatcataaagaaaatcaatcctttccctatagatgtaacataattctgccaaaaacggaactactctgcttttaaattagaaggataaatgtgagagaggctaaagtcattattggttcagtgaaatctttactgacttgaatcgtccgtctttttttgctatactgtttagtgaattgaatagaagacagacaaaggttgagcatttcgatgcttcaaggatcacgttctccaaggggtgaggagaacattcttgaaggcgtgccgatcttttttttgaaggcatacttctttacgaggtatgccttttttgtgtctatttttcaattgtcttgtttactttgacaataggagggatattttgatggaagaggcactgaaacgcctgcaagaggcagaagcctataatcaacagcagatgcagcaattgcaacgggcgctgtctgattacgaagaagagaagcaggaggaactacaacagcgtgtacttgaattgagagcagcatgtctgcgtgaacagtccgcacttgaacaacaattacaacaaacgttgcaaaaaacgacggaacagatcgaagcagagaaacaacagtttattgcagatctccaagaaaatgttcgtcgctgtcaagaacaaatggtcgatcagatcgttgaaggagtgatccaaacttatggcagtcacgaaactaagtaagctgaccttgatcgcccccgaaaaccatcaagagcggttattgaaaaaactgcaaagcttacagatggttgagattgaagatgtctttgaaaatgcagaaaatcaaccatggctcaaagaattttttgctgattatcaacaagagacagcgactagctacgcagagacgcttcgcaggatccaagaagcaatcttgttcatccggcgacaaggcggaagcggcaaaatacgagagtggcaacgccaatctttacaactgcctgcatttgaagactcctttcaagagcaaactgtcttgacgcttgtcgaacaaattgaagagttgcagttacaatggcaaaaaaatcatgaagcgatgcaagccgcttctcaatcagaaacctgggcaatggaatggcaaaacctggatgtttctctcgaagaaaaagagttggcatttgccactttcttttgtggcagtgttgaaagttctcattgggaagccatatcagcgaccctcaaacaacttgatgctgtttacctggaaatgatttattcggatacaaaaaagacaaatttcagttgtctttacccgaagaagctttctgcagaagttgagaatgtttttcagcgatatagtgtaaaaaaagaaaatacggacagtctgaaaaaaccaaaagtgctgttgcacgaggcccaggcaaaactgcgagagctagcggatcagcgaaaacagctggcaaatcagattggcacgtataaaactaagattgcttgtttgcagcaagcagaagaatattttttgacaaaagaacaacgaaaaatggtacgaaaacgattggtcactggcaaacatcatactgttttgagaggctgggtcgcgcaacaagatcaacagactcttgaaaaagagctggcagattcttttaacggcgaagtctattgctcattcaatgaacctaccttagaagaattgactgcgaatcaagttccagtcaaactgcaaaatgcttcgtttatcaaaccatttgaaatgttgacggaaatgtatagtttgcctaaatatgatgagatcgacccaacgccttggatgacacctttttattatgtcttctttgggatgatggttgctgatttgggctatggcggattgatggcactggtgaccactattggcctgcactttttccgtttacctaaagggacgaaacggtttatgaagctgtttcaaacattatccggtcctacgatgatttggggattgatctatggctcgtttttcggagcgactttgccatttcatttgttatcgccagcgaaagactttatggctatttttggattatccatgatttttggagggatccaattgtttacaggtctttatttggccgcgaaggaaaatattcgcaagaaagattttttagcagctgtcaatcaaggcttttcttggcaaggcttgctggcgggacttttggttgctgctgctggaaattggctctttaccgccccagcactcgtcacattaggattgattatagcaggacttagcgggctgctgatcgtgattgtgccgatcattaaaggaaagtccaaagttggcggttttttcatggggatctatgatctctatggggtaacaagctatattggcgattttgtcagctatagtcgtttgatggcgttagggatctctggcggcagtatcgccgctgcctttaatttattagtgggctatatgccgccggtagcacgattttctgttgggatcattctgttagtgatcttacaggcgctaaatatttttttgtcattactaagtgcttacgtgcatgcagcgcgtttacaatatgtagaattttttggcaaattctttacaggtggcggccgggcgtttgacacctttaagccgagtgaaaaatatgtcgattttgaaaaagaaaacggaggaaagaaagatgattgattacttgattaataacaacggtggaatggtatttgcgattataggaatgggaatcgcaacgattttttctggaattggttcagcaaagggtgttggaatgacaggggaagcagctgcggcgttgacaacgaatcaacctgagaaatttgggcaggcactgattctacagttactgccaggaacccaaggtttgtatggttttgtgattgcctttatgatctacggcagtttggcagcagagatgtcgacggtgaccggaatggcctatttgatggcttcattgccggtagcttttaccggattgttctctgggatcgcacaaggaagagtggccgcatcagggattcaaatcttagctaaaaaaccggaacactttttcaaaggagttatgttctcagtcatggtggaaatgtacgcgatcttaggcttcgttatttctttcctactattagggtccatttaaaggaggcgacaagcaatggaggcaatggatgccatcgacaaaatgattgctgaactagatcgggaagcaaaagaaaaacggcaagtaatcgaaacggacactaaaacaaggatcgatgccgattttgcagctgcctggtcccaaaaagaactagaaatcaagcgccattcagtagaagcaaaaaaacaaatcgaaaaaaactatcagcaagacatgaatcggcgaataaaagcagccaaacaagaagggattaaacaagctcataaagaactggagacattattcgcggcagcttatcaaaaaatgaatggattggcgcctgatacagtccaacatctggcggaaaatacattaatgcaattacccgtttcgggagaagtaatctttcgttgtggacagcaacagtcagcaagtttgacaaaagattggttgactgctgtcaatcaaaggttgccttatcttgcaaggatgggcaaaccattggagcaagcagggtttatagtagaagacaatggcgttttctacaatttcacctaccaagctttactagaagaatacaaaaatgaaacgagagaacattggctgaaagtgatccaaaaaggagggtaagctatggcgagctatcatcaattgaatccactgattcggatcaaagagacaaccttgcttcaaatgcaagattggcagcagctgattgcagcagagtctatggatcaagtaatggcaatcttgcagcaaacgaattatcaacgttatctgggcgctgatttttccgaaaaatttgaggggtatctggatcaagaaatgctgacaaccatacaagaattagcagaaaacgttccagatcctgatgtgcttcgtttgatcatgctgccgtatacctttcataatttgaaggtattgaccaaagaagatgtaacagggagagattatagcaatttactgatcgaagatggattctatacgatcgatgaactaagaaatgccatccaaacaggatcttcggaaagtataccgtctaaagtcattgaaacgatccaagcagtaagggaatacttagaaggttctgctgttttgcaagggatcgatattatttacgatcgccgctttttacatgagcaacgacgcctagccgaaaaaataaatattccagcactgacacatgcggtgatcacaggaatcgaccttacgaatatcacgattgctgcacgttgtttgctgcaaaaaagatcaaaaagttttatggcggctgttttagtcagtgtgggaagtattcccaaagaagattatctcgcttttgcggaaacctccttcactgactatctcgcctttttgaaacaaactggctatcaagaagcgctactgccgctattacaagagaccacgatcgattttgctgcattggcactggtgaaagatgacttagttactcagcagttcgtagctgctgaagcgttgggaccaatgccattactcgcgtttttaaatgccaaaacattggagattcagaacttgcggctgattttggtaggaaagcgcagtggcttcacagaagaagagctgagagagaggatgaggtactatggcagctaagattggtgtgatcggcagcaaagaatccgtgttaccttttcagctgtttggctttcaagtgtgttacgcaaccgcaaaagcggaagtgactcgtgcctttcagtgcttagtgaaagaagagtatgcggtgatttacgtaacagaaaaatgtgcggcattgattccagaagaaattgccaaataccaacagcaagtttcaccagcgatcatcttgatcccagattacgatggatcccaaggggtagggctgaaaatgatccaggaaaatgtcgaaaaagccgttgggcaaaacatactatagaatggagctgatgttgtggaaacaggaacaataattaaagtgtcaggtccgttagttttagcaaaagatatgggccatgcaagtttagaagatatttgttatgtcggtgatctgggggttgttggagaaatcatcgagatgagaggaacgatcgcttcgatccaagtttatgaagaaacgtcaggtatcggaccaggagaacccgtccgaacaacaggagaaccgctgtctgttgagttagcaccgggaattatgtctcaaatgttcgacgggattcaacggccattagaaacatttatggagctgacccaaagtaactttttgaaacgaggggtccagctgcctgcattggatcatgagaaaaaatggacctttgaaccgaccattgcggtgggaacggaagttactccaggaatggttatcggggtcgtccaagagacgccattgctcctccacaaaattatggtgcctaatggcgttacaggacgggtcaaagaagtttttgctggtgattttacgattgatgaaacggtttatattcttgagacaccaaaaggagaacgctccttttcgatgttgcaaaaatggcccgtacggcacagtcgtccagtcaaacagaaattaaatccggtagagccaatgatcactgggcagcgagtgatcgacactttctttccaatcgcaaaagggggagcctctgcggtccctggccccttcggtgcgggaaaaacagtggtccaacatcaaattgctaaatgggcagatgtggacttagtggtctatgtaggctgcggagaacggggcaatgaaatgacggatgtaatgaatgaatttccggaactgattgatccacgaagtggcgaatccttgatggctcgtactgtactgatcgcgaacacttccaatatgccggttgccgctcgggaagcttctatctataccggaatcacgattgcggagtatttcagagacatggggtattctgtagcgattatggccgattccacatctcgttgggcggaagcgttgcgagaaatgtccggtcgcttggaagagatgccaggtgatgaaggctatcctgcctatttgggcagtcgcttagccgagtattacgaacgatccggtaaagtgatttgtttaggctcggaacaagaagggagcatcactgccattagtgcagtatctccatctggaggggacatctccgaacctgtcacgcaaaacaccctgcgagtggtgaaagttttctgggggctggatgccacgttagctcaaaaaaggcactttccctctattgattggctaaaaagctattccctgtatgagaatgaaatgggcgcttatctggatcgtcagttgcaagtggagtggtcgaaaaatgtgactacggctatgcggatgctgcaaaaagaagctgaactttctgaaattgtgcgtctagttgggattgatgccttatcggataaagatcaactattgttagagatcacgaagtcattgcgagaagattatttacaacaaaatgcttttgatgctgttgatactttcacttctcgagaaaaacaatttgaaatgctgcagaccatcttactgtttcatgacgaaggtcaaaaagctttagaattaggcgcctatttgacagaaatctatcagggaacagaacgtctgcgagataaaatcgctcgcatgaaatatcttccggaagatgatttagaaggaatccgcaaattggaaagcgagataaaagatacgatgaaagaaatcttgcagaaaggagatcgtacggatgatcaaagaatataaaacgatcggggaagttgtcggtcctttgatggcggtcgatcgtgtctcaggagtgaaatatgaagagctgatcgaagtacgtctgcaaaatggtgaaattcgtcaaggtcaagtcttagaaattcaggaagataaagcactggtgcaaatctttgaaggtactggcggaattaatttacgagaatccagtgtgcgcttcctcggacatccgttagagctaggtgtttctgaagaaatgattggccgggtttttgatgggttaggacgagtcaaagatggtggttcagaaatcattgctgagaaacgaatggacattaatggggaagtaatcaacccgatggctcgagattacccagatgaatttattcaaactggcatctcttctatcgatcacttgaatacgcttgttcgcggtcaaaaattaccgattttttctggttctggtctgccgcataaagaattagcttctcaaatcgctcgtcaagcgcaagtgctcgacacagaggacgactttgcggttgtttttgcaggtatcgggattacgtttgaagaagcagaatatttcatggaagattttcgccaaaccggagcgattgatcggtctgttgtctttatgaatttggcaaatgatccggcaattgagcgaattgctacgcctcgaatggctctcacagctgccgaatatttagcttatgaaaaagggatgcatgtcttagttatcatgacggatatgaccaactactgtgaagcgttgcgggaaatatcagctgcccgtcgtgaggtacctgggcgccgaggctatcctggttacctctatacgaatctttccacattatacgagcgagctggccgcttacggggagtgaaagggtcggtgacccaaatccctatattgacgatgccagaagatgacaagacccatcctattcctgacttgactggttatatcacagaaggtcaaatcattctttcaagagagttatacaaaaacggcatccagccgccgattgatgtcttgccttctctttctcggctgaaggacaagggaacaggtgaaggcaaaactcgtaaagatcatgcatcaacgatgaatcaactcttctctgcttatgcgcaagggaagcaagccaaagaactcgcagtcgttttaggggagtcagcactatctgatgtcgataaaatctatgccaagtttgcggaacgctttgagaatgaatacctggatcaaggttatcaaacaaatcggtccattgaagaaacgttggatcttgggtgggaactgttggcgatgctgccgaaagtagaattgaaacggatcagcgatgcgttactagaggcgtttttaccacaaggagaggatgcagatgagcagacaaaccgttaatccaactcgcatggaactaagccgcctcagcaaacagttgacgactgccaaaagaggtcataaactgttaaaagacaaacaagatgagttgatgcgtcagttcatcgaactgatcaaacaaaacaaccttttgcgtaaagaagtagaaacacaactacatcgtgccatgaaggcttttcgcctagccaatgccacgatcaatgaaaagtacattgaagaaatgttcatcttgccagcaacagaagtttctcttgatgtctcaaccaagaatatcatgagtgtggaagtgcctgtgatgcaattcgactatgatgatgtggtgatgcaggcaccgatcgagtatgggtttgtgaactcgaatgttcctttggatctggcaatgggacgtttcaccgatgtcttgcctaaactattgtctttgacagagatcgaaaagacctgtcaattgctggcggatgagatagaacgaacacgccgccgggtcaatgcgctagaatatttgacgataccagaattggaagagacgatctatgggatcaaaatgcgtcttgaggaaaatgaacgcgccaatgttactcggatgatcaaggtaaaaaataaaacaaagtgaatgccacgtcagtcgaaaatctgcttggcacaaaggtaggaaagaaagatgaaaaaaagaatgtccaaaaaaatcagtgcaccgcagctggttacactggtctttatgatgttgatcttgatgggaactgggttgcttatgttaccagttgtaacaaatgatgggcaaggtgtgcctttcttagatgcattgtttaccgcaacttccgcgatttgtgtgacaggactttcgactttttccatttctgaacagtataatatgggcggacaagcgattcttttgatcttgatcgaaattggggggatcggttttatgtcgatcccagttttcttttatatcttagcaaaaaaaagggtcaatttaagcactcggatgattctaagagaatccctcaatcttgaccgaatgtctggcgaatttcaattggcttggtacattatccgcatcgcatttttgattcaatttttagggatctgcctgttggctctgtcttttgtgccacgctttggttggcagcaaggcctatggtttagtatttttcacgccatttcttccttttgtaatgctggatttgatctttttgggaatagtctggtctcttttcagtcggatccttttgttttaggggtcattagtcttttgatcattgccggcggcttaggctttctggtctggtttgacttgttagctacttcaaaaagacgctcgttgcacagccgtattgccttgttggcaatgattgttttgctgattttagggacggttggtttttatgtgaccgaatatcactccagtatcgtatcaggcgattccattgttagtcgctttttccagttattttttcttgctgtgacccctcgaacggctggattttatagtatcgattatggccagatgagtcaggctgggttaatgttgacgatgattctcatgtatatcggcggtacttctggatcgactgccggagggctgaaaaccacgacggtctcagtgttgatcattaagattcgcagtttgttgaaagggcgcaaacgagctgaagtttttggcagaacgatcaaagaggcggctgtttcgcgggcgttcacgctctttttcttaacactgagtctttgctttattgccatctttttattatccatcacagaatcgatgccggggaattctcagtttggactggagtacattgcttttgaagttttttcggcttttggaacagttggattaacaatgggattgactccgtatctttctgtatttggtaaattattgatcatcttattgatgtttattggtcgtgtgggcatcatgacggttgctttttcattgatgacaaaagccaaccgccgagaagccggatacaaattcccggatgaaacggtcatgattggctaagatctgttattaaaagttgttttggatcaatggaaatcatccccgaaaaatattgccgacttttaggttagtttaaggtttctcgtctaagatcttcctaagaactaaatgagtcagttgcagcatttcgttagagctgctaggacaatccaaaggtgggaagaccatgagcttgtgggaattgtggtttgtaggaaaaacttttgtgaccgtgctgctagtcgtttttttactagaatggctgtacttgttacggaaactttcaagaaaatcgcagcagttgatctatttactgctgattttggttgaatggcacagcaacggctggatcgggctcctaacaagtttagtatgcggaacgtattttttcgggcattggaaagagcatgctgatacgactgcatcgattcaatcgacagtgtatggtgatgggcaagagggtactgaaaacttgatgcaaaaatactagcatggcttgggtcaatgggaactattgccgctgatatgcttcttcatagaaaagacactgctagttaaaaagaacctgtggtaaacgaaaagataacttttcgcagcacgggttctttttgataggattcagtgagtgatttacgccgttttgcttactacgtggaaatagccttctttgtcttgaatgatccagacattttgattgtcattcttgacgatgacgattccttgtacgacctcattggtgactgtgcgaaattcttctttattcatttcgatacctccaaggtagattccaattattttcagaagggggcagcacgacagtagagaaaaagccgtgctgcaaagcaaaaagaaaattaattggtagctatagtatacaggcaagatattgagttctagtcaatttcatgtaaataatcggttaaaggagaatcaatctgtcaaagaaaaacgcagtttcattttggtattgcctctttccaccatttctcctagtaattgagtggcatgtgataagtaaagctgggccatttcacggttggcttcttccaataactgatttgttaatgggattgtctgatcgatcttctgctgaatcgctagacaatttgccatgattgtttgttcaaaccgttctgctagatcgctgtatagatcatagtcttgatccccgatcagtgctaatgttttagtcaaccaatagctatttcccggatcgtaagtagtggtggtatcacaataacctttcggggtctcattcacattgctgtaaaaagggaccactccattgaaggtattgggaccaaaagctaaccagtgaacgcctgcaatttcatcaggtacgtgactgcgcacttggagaatatgcacttgctgattgcgattgagagcaatcgaacgaaagcgagttctctcactagccgttccattcccgtacggatcataaggggtattttgaaaatgactgctcaacgcccactttacatccatcacgctgattttctttttcggaagacagatgaaaggtagatcttggtcaagcggatccgacgcggtttcgctgaactgtttttggatataccaagctctagggttgttataacgagtatctttttctgttgcactgccgaaaatatgacgtaaattgattcagatcggaagagcgtcgtgtagggaaagagggtcttcgccnnatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagcccttttttataaagattccctagttgtatcaagagttgttcctattgataggattaggcgctaacgctttaactgtatctaaagcagcaactaagcttactcaactaatcttattcaacaaattcaaactcaaaattaccgatgcgcacgatatcgccatctttggctcctcgcgcacgtaacgcttcgtctactcctaacccgcgtaattgacgggcaaaacgcatgactgtttcatcatgatcaaagttagtcatttggaagagtttctcaatcttttcaccactcaagatccaagtagcatctggatcacgatcaatggtaaattctggttcatccgaatggaacccatattgaacaacttcttcttcgatttcctcatcatacaataagaattctggtgtgacttctaataagtctgcagttgcactcagtaaagcatcaattcccttacgagtgacacctgaaattgggaaaatcggcaaaggatctgcgaattcatcggtttgttcttttgctaattgctctttgaatttcaccagattttcttctgattctggcatatccattttattcgctacgataatttgcggacgttcaagcaagcgtaagttatgggttgctaattcttgattgattgcttgatagtcttcatacggatcgcgcccttccatcccactcatatcgatcacgtgcaaaatcactcgtgtccgttcaatgtgtcgtaaaaactgtgtacctaatccaacaccttgcgatgccccttcaatcaatccaggaagatcggccacagcaaaactacgaccatctgaagtcgttaccatccctagattagggactagcgttgtaaagtgataggcaccaatcttcggtcttgcagaagaaatgacagaaagtaatgtagattttcctacggatgggaaaccaaccaagccgacatcagctagtactttcaattccaattcaatttttctttcttggccaggttcgccattttcagctagttctggcgctggattctttggcgaagcaaaacggatattgccgcgaccgccacggccgcctttggcaatcgtcaacgtctgtccttgctccaacagatctcctagcaaagcacctgtgtctgcatcgcggacagtggttccttggggaactttgatatacgtatcttctgctccgcggccatgcatccctttactcattccgttttcacctggttgtgctttaaaatgacgattgaaacggaaatccattaacgtacgcaagccttcgtcgacaactaaaatcacatcaccaccgcggccgccatccccaccggctggtccgccatcgggaacgtatttttctcttctaaatgcaaccatcccgtctccgcctttaccagctttgacatcgattgttacctgatctaaaaacatggacatgttatgtgccctccattctctcttcttaccttctaataaaccaatttgaatacaattcatgccatttgcaggccaaagttcacctttaagaaagtctatttaattgtaacgaccgcaaggccatttgtctatcttttctgcctcttttcccaaagaactagataaaaatttaagggtttttctttgacagaatcctggtttcgtagcagaattttaattgtaagatcaaaaaagaggaggaacaatagattatgacagtaaaagtgggaataaatggattcggacgtatcggtcgcttggccttccgtcgaatcaaagaagtatcagatgatatcgaagtcgtggcgatcaatgatttgacgagccccgtcatgctagcccagttactccagtttgattcaactcatggtacctatccaggcacagtcactgccacagatgatgcgatcgtcgttgatggagaagaaacaaaagtctacgcagaacctgatgccagcaaaattccttgggtgaaagaaaatggcgtggatatcgttttagaatgtacaggcttttatacatctgaagaaaaagcacaagcacacttagatgccggtgtaaaacgtgtcgttatctctgcaccagcaggaaaaatgaaaacgatcgtttacaatgtcaatagtgatacacttactgcagaggacaaaatcatttcagctggttcttgtacaaccaattgtttagctccaatggcttatttcctaaatgaagaatttgggatcgaagtaggaactatgacgactgtccatgcctacacttctactcaaatgcttttggatggcccggtacggggaggcaacctgcgagctgcgcgttcagccgctgataatacgatccctcattcaacaggagcagcgaaagcgattggtttggtcattccagaactaaatggcaaacttcaaggacacgcacaacgggtacctgttgtcgatggatctttaacagaattggtatcgattctgaaacaaaaagtaaccgcagaagaagtcaatgaagccatcaagaaacacacgatcgacaatccttcttttggctacgatgaccgtgaaatcgtctctggcgatgttatcggtacgacgcaaggatcaatctttgacccgacacaaacagaagtaactactgcaggagacttccaattggtcaaaactgttgcatggtatgacaatgaatatggttttacttgccaaatgattcgtttgttagaaaaatttgctaatttataagctactcattacaaaaagagcgaagatctacggatcttcgctctttttttgctattctggcaagtgatcatacttttcaaggaatgccgcaattttttcctggtaacgttttggatctttcgtgtagctttgggcatgttccgcccctttgactacccatttttcttttggcgcatctgtagcagcataaacctctgccaacattgaataaggaacgaaagtatccgaatcaccatggatgaagaacattggacgagtgttcttgtgcagctgtttcacggcatctgcttcgccaaagaagtaaccagctcttagcttggtaaccagactagtgacattgatcaaaggaaatgctggcaaaccaaataattgatccaactgatagctcaattcctcatttacagaagcataaccgcagtcctcaatgatcgctgttacgttggcaggcaacttttcgccactggtcatcatcacggtagcagctcccatacttacaccgtataaaacaatggattcttccttgccgctttcttttaagatttgatcgatccattggacataatctttccgttctggccaaccaaagccaatataatcgccttggctttctccatgaccgcgggcatcaggaaccaatacgttatatcctagatcatggaacatcttcgcataaactcccatcgtctctgcgtttcccatataaccatgggcgacaatcactgttttgtgctgtgatttttgggcaggcaagtaaattccggacaacatcaatccatctgaggattcaagttgccacatttgacgattttccggagcggtaaaccactcctccgcttcaggattcgcattgcttttgtccgttccagaggtatcaccttttaaaaaatctttttctgatgggacaactgcgtaattataaaaataatttccggcatagcccaagcctactatcaaaagcacccctactaaaatggcgatcttccagcgtagtttcattttgttcctcctcgacaactagtttacataatataattattggttgtttatttcaagaaacgcgcttgaatctgctccttattcaggcgatatttgaaataaagatgaaatccgcccgccaacatcaacgtgatcccatacacccacatctgatgccaaaaataaaatgtattgatgaccgcaaagacccctaaaacggcaaaaaaacagccatataagcgccaaagaaagccatcagttcctaatttggtaaaatatgtctcccattcttcactggtcatgtgttgtcgtttccgcttttgctggaaaatagcaatcagtaagaaaatcgacaaaaaaccagccagacgaatggtaacgataaataacaataacgttttaataataaaaaacaccgttctggttgctccctcctaaaaaacattctagtacaaaataccccttttacttttgatttgtcaataggaccaaaacgaaaaacagtcaaactaacacttcaacaagcgctaccaagtgctgctatgtaaagagcagagaagtaaagagtaaagaaatttttgctagcaggcggctcctttcaacagtcctcaccttcttaccatcaatctcatccacatgtagaaacgcgccttttttccccacactgcacggacgaaagctattaaacaaaaagaaccgctcaaaaagagcagttctttagaaaaacaaagcgtcttattcgtctttgctgtcttttagtttaaagcttgaccatggtttcaagaaatccagtagaaacagttcatctgcagcaatttttcctacgacattgacacggccatcattcttcatttctttcaatgcgatctgagtttcacctttgtattgcccataaccgacgttatcgatcaaaatatcaccgcgagtcatatcatgggtatcatgtgctgggaatggcttatctttgtagtaaattcgagtcatcgtcgaccgcaaaatatattctgagcgatccccgcgataaccatgaagattatcaaacaaacagatgcgttcatcttccgtgattccttcagcaacatctacttttaaggtaggatagtccgcattgaaggcttctgccattgcagctaactctttttctgatgcataggcatttcccactgaaatatcatcgattaatcctgtcaaaaccaaatgtttgacttgagtagcgattggcagatcacgatgatcttccaacgaacaaagcccatcttgtgttggccaaggaccaaatgttgcctcgtgagaattcacaaaagccattgtgttcaagttgtaacgacggaatttttctgagcaatacacaaaatggtcataacccaaacctgaatatcgatgagggtaaaaattgtgagagcctaataaattattcgtatttggcgaataactcatgatattgtctacgtagtttgtcccactgctcatattgatctcaattttgatgccataaggattacgcgtcatacgcgcttcttcggcaccggtaaaaccgatatccaaacggacaccataagcacccatttcatcaaagaatgaaagatcatcatacgagatctctaattgatcaaagagaccaggattgatgtccaccatgacttccattcctaattgattggcataatccactacctgcttgaaatctgccaatactttttctttatcatcttcgatttgcagcaaacttgtaaacacacgcttaaagccgtatttgtgtgctaaatcaagataagccttgtctttctcaaacgttgatcgttctggataaactgaaatacctaattttcccatccgtcaaacctcctaaaaattctatccgttttttgttcatgaatcctctttcattatagcaaacaaccgataagtggtctacacctttcctattggttttaatagatacctgcttttcactccagcttaattttgatatgataaagacagtctagtaatgaaaggatcttactcaaatgaaaaaaatgatactaacgttggcggcagcaactagcctctttctattaactgcctgcaatgatacaacaactacttctagttcttcggataaaacaaccacatcagaatctgtagacttaaattctctggaactgccgcagttgtctactgaagtaaaagaaaatgaagatcttgttgcacttgagaccacagaaggcacgatcaaaatcaaattattcccagaaattgcaccaaaagctgtcgaaaactttatgactcatgccaaaaatggctactacgatggcttgactttccatcgaatcgtcgaagattttatgatccaaggcggcgaccctaacggtgacggaactggtggagaaagcatttggggcaaagggtttggcgaggaaatatccaaacagctttaccatatccgcggcgcgttatcgatggcaaaatccagcgctcccaacagccaaggaagtcaattctttattgttcaaaaccatgatgatgtctctgatggacgagcaatccaattttatcctcaaaatatcattgacgcctacaaagatggtggtgctccgacactagatggtaagtacacagtctttggtcaggtcattgaaggaatggaggtcgtagacaaaattgccaaagccgaaacgaccggtgaggcgaatagcaacggagaagactctacgccaaaagatcctgtcaaaatcaaatccatcaagattttacaagaagctaagtaagcaaaaaagaccaatgcctttgaaaatttcccttaaaggcactggtctttattttatttttgttctccaacaataaaggtaaattcacactccgctgctttttttccttccacagttgccacagcattggctgtccctacagaacctttgatttttgtaatctcaaaaacaagtttcaaggtatcgccgggaacaactttttgacggaattttgctttgttgatcccgccaatataagcagttcttccctgaaattcatccgatttcaaaatcaagatcgaacctgcttgtgccaatgtttctaaaatcaacgctcctggcatcactggatttcctggaaaatgtccttggaaaaaatcttcattgatcgtcacatttttcgtggcaatgatcttcttccctgattcaatctcatcaacgtaatcgatataaatgatcggatagcgatttggaatcaagtccatgacttctgtttctgtcaatagttttttcatggggtttccttccttgcttaaaaaaatattatagtttgattatcaaagtatcatagttctgattttttcgcaactaaatatttattaataaaaaaatagtttgacaatcaaacaattatgaataataattagaaatcatgatagtgggacccactatcgatcgtcattattgattattatgcaaactattaaggagtggaattatgagtttcttaactggaaaaaaagttgtcgtgatgggcgtagccaacaaacgcagtatcgcttggggctgtgcgcaagcgctaaaagaacaaggcgctgaagtcatctatacgtatcaaaacgaacgcatgaaaaaacctcttgaacggctactagaggaaaatgagtatacggttgaatgtgatgttgcaaatgatgagagtatcgcgaaagcttttgaaaccatcaaagactatgcaggcgaaatccatggcgtcgtccatgctgtcgcttacgccaacaaagatgatctttcaggtgatattttaaatatatcaagagatggctatgcactagcacaagatatcagcagctattcattgatcgctgttactaaatatgccaaacccctcttggcagaaaatgccggaatcgttaccttgacctatttaggttcagaacgtgctgtacccaactataacatgatggggattgctaaggctgctctcgaatcaagcgttcgctatttagctgcagaattatccccgcaaaaaatccgggtcaacgccatctctgcaggcgcaatcaaaacactggctgtgacaggtgtaaaagattatcaaaagctgatccaattatctgaagatcgcactcctgatcatgttggtgtgaccatcgaagaagtcggcaacacatgtgcctttctgattagtccattgtctagcggtatcatcggagaagtgatttttgtcgataaaggtgttcacttatcgtaattctatgatcacatgtactcgtgctcgtctcttgactggtctatgccaagagacgagtttttgctgtttctttgctaactaatgatattcccttatttgttcatctttttacaaaaatttaacaagtgaattttgcatttctgttttttctcctataaaatagacttattgatagatggagggattttatgttacgacttttgacagatgctacaacggattcgacaggatccagcttgacggagcctgccgccaaacaattgaatgccttgcagaaatggtggcaaaacattgattgggaggctattgttggtatcttgatccaaaaagttctgatgctgctttttttgattattttatttggtattttgctgaaaatcagcaattatgtcatcgaacgaatttatcgttcctacgagaaaaaaggaacctataatgccagtcgaatcaacacgatccatgcgctgatccgcaatatcgtacactatacattaggtttcttctttgtatatgcgttattgtcaacgattggcgtgcctgttggttcactcttagcgggggctgggattgctggggtggcactgggactaggtgctcaaggctttatgaatgatctgatcactggtttttttatcattactgagcaacaaatcaatgtcggcgattatatccgtttgacgaatttgtcattagaaggaacagttacagctgtcggtattcgaacggttcagttaaaatccgtggatgggactgtccattatatcccgaatcggaatatcactacgatcagcaacacttcacgagccaatatgcaagtcgttgtagatgtgcgtatcttgccatcagagggcttagatgatatccggtcgatcattgacgaagtcaatcaaacagtggctgctgctcacgaggaagagatccaaacgaaaccagcaatttttggtgttgtcgaccttggcaacaataattttgcgatccggacaacgatgtatgttaccaacggaactcagtggaaactaaaagaagagtttttagcggcttcaatcgatgcactgactgctaaaggctacaccattcctagtgcgccaatcattggcgtcaattgaccgcttaaacgttaaaagcaccccgatgatttttggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagaatgcagcggctctgttgtttgttctatggacaattattccataacggaaatatcaaagacttcaatattatctaatccaccataaaattcataccatggggtagcatattcttttagaatagcattcagttcttcgacattttcccggccttgcgtatctaaccaatcaagcagtgctttttccccttgttttccatagatttccacgctgtctcgccaagttgcacgtccgccaagaataccagagaactttgccccgtgttcgccggcaaagcgtaattcttctcggaagatgtttgcaggaacccctgcacttaagtaaatgaaaggacgagtagcggcatcgctagcttctctaaagtagttggcagcttcttcttgggtatacacagcttctaagccttctttttgaaacccttcaaccaaatcaaattgtacgggtacttcaacttttaaaatatcgatatggtatttgtctttggtcaattcttgaatcgttcgaatgacttttccaggtttgattttagcgaaagccggtgatttatcatcggtgatttcatcgtcgtagacgattggttcgacaaaaattgggatatcggctgcttgtgcttccgtacctaaacgttctagaaaagcatgtttcgtatcaagaatctcttgcggttcatcaggattgtaataaaccagcactttagctgcgtcagctcctttttggactagacgttgcagagattcatttggcaacagctccggcaatcgtcctggagtattgacatcataaccggttttttcataagacagaatcaaaccagcattaggatttttcgcttcgatgccttgaaatccatattcttcatccaataaaatgctgctgacatactttgtcaattcttgtgaaaccaaccgtttgaagtcataaatttgttccattttgaaattatcgggccctgtggcagctttcatcatttttttcattgatcctcgctgatcaatggccaatgccgcaatcaccccatcttcatttgaaagtttctgcattttttcaaatttgcctcttgaaatacgtttcatttgtccagcctcctttaagttctctttcagtctacgccttctcacaaaaatcgccaactaataagcaatttctagaaatgcaaacaaaaaaacgaagctttgtcactaccccgcaagcaatgggatgtgacagcaactttactcagatgcaagtctgcgaaagattcgaaattccttgtatttcattgtgtcagatcgttaagagaataaagactatccttgtgaatagtggaaatagctcgccatttctgccgcatgcttgccagcgacatgaccagtacaaaaggcagcagtgatattgaatccaccggtataaccgttgatatcgagtaattcgccgccgaaataaaggccattgatgcacttactttccattgtcttgggattcacttcttttaaatgaatccctccacccgtcacaaaagatttttccagcggaaatgttttagaaattgtgacagaaaagcctttcatgatagctgctaaagcctgtagctggtcttcagttgtttgctcagccaccagatcagaaagtgccagtcgatggataaagaactctagcagacgttccggcaagatgccgctcagtgcattgactaattttttcttcgaatgggctgccactgttagctcattcaccaattcattcgctgttttttctggaaaacaatccagcatcactgtgacaggtgtatgactcttcaattcttgattgacaaaagaagagcagcgcagtgcagctggacccgaaagcccgaaatgcgtgaacaagagatccatggtatgagagacaacggtttttcctgtagaatctaaaacagataaagcaatatcttgtaaagagatgccttgcagtgtgcgttctttgataaatggctcctctgatatgaggggagactcggtaggataaagcggtgtgatggtatgccctacttttttggccattttgtagccgtctccagttgctccagtcgaagggtaagttcgaccaccagtcgtcaggatcacacagggcgcagtaaattcttcgaattctgttcgaacgccttggatctgagtctcatcatgaagtaatttagtgacgactgtattggtcaatagagtgacttgtttctcatggagcgcctgtaataagccttcaacgatcgttttcgatttgtctgtgacaggaaacatccgtccgtgatcttcttctttcagagggacaccatgggattcaaaaaaggtcatcacatcgaaattattgaattgcgagaatgtactatataaaaattttccgttgccgggaatatgggcgatcaaatcatcgacagagcgatgattggtcacgttacaacgaccgccgccggtcataagcaattttttgccaacttttttatttttttctataagtaatacgtctgcaccgttttcggctgctgaaatagcggccatcatgccactggtcccagcaccaatcacgatcacatcataggatttcttcatcttccttcacctctttgtggattgtaccatattgcaggaacaagcggggagaaagctgtttgttcaatgaatcgaaaaaaaattctgacaatttcgtaaaaaatagatgcaatttctgaaattttctataaaatagaatttaactaaaggaggtagtgcctgatgacaaatgcttcagagtatgtaaaagcgatccaagagaaactgcacgaaaaagatcagaaccaaacggaatttttacaagcgatagatgaatttttaccaacaatcattcctttcttagaaaaacatccagaatacattgaatcgaatttggttgatttattaacagaaccagagcgatttattcaatttcgtgtgccatggcaagatgaccaaggcaattggcaagtcaaccgcggttatcggatccaatttaattctgcattagggccttacaaaggcggcctgcgttttcatcccagcgtcaacttaagtatcttgaaatttttggcttttgagcagattttcaagaacagtttgactggattaccgattggtggcggcaaaggcggaagtgactttgatccaaaagggaaatcagatggagaagtcatgcgtttttgtcaaagtttcatgacggaattagcaaaacatatcggccctgacttagatgttcctgcgggggacattggtgttggtggccgtgaaattggctatctctttggggcttacaaacgtcttaaacaatatgatgctggtgtccttacaggaaaaccattggacttttggggaagtaaaaatcggacggaagctaccggttacggggcagtctattttgttaagcatctgttgaaagatttaaaggaaaacttccaagggaaacaggcaattgtatctggaagcggcaatgtagccatttatgcgattgaaaaattgcatgagttgggcgcaaaagccatcacttgctctgattcttctggcttcatttatgacaaagaaggtatcgatctggcattattgaaagaaatcaaagaagtgaaacgggaacgtttgacagcatatgccaacgcacgcacctcagcagagtaccatgaaggcgcttctgtctgggacttcgatgttcaagcggaattagcattcccttgtgcgactcaaaatgaaatcaatctagaacaagccaaacgggcaaaagcgaatggtgtccggattgtttctgaaggtgccaatatgccaagctctcttgaagcggcagaatattttattgcgcaaggaatctactattgtcctgggaaagcggctaatgcgggtggcgtagcggtttctgctttagaaatgagtcaaaactcacaacgtttgcagtgggagcaggcagaagtcgatcaaaaattggatgagatcatgaagaatatttatgatgcttgccgtgacactgcagaagaatttgatcaaaaaaataatttcatgctaggagcaaatgtggctggatttgaaaaagttgctaaagcaatgttttctcaaggacttgtctaactctgccagataggcgatataataaggaattacttgaaaaaagttcaaaaaaaacgtaaagtagtacttgtatgaaaaactaatttttttcaaggaggacaaatcatgtcacacatcaaatttgactattcaaaagtagcaccattcgtgaatgaatacgaattaagctacatgcaaagtcaagttacagcagcagataaactcttacgtgaaggtactggtgcaggtaacgactttttaggctggatcgacttgcctaaaaattatgataaagaagaatttgcacgaatcaaaaaagcagcagaaaaaatccaatcggactcagaagtattagttgttatcggtatcggtggttcttatttaggggcaaaagctgcgattgatttcttaaaccattcattctataacttgctttcatcagatgaacggaaagcaccacaaatcttttttgccggaaactcaatttcttcgacttatttagctgatttgatcgaaatcatcggtgatcgtgatttctctgtcaatgtcatttctaagtcaggaacgacgacagaacctgcgatcgcattccgtgtcttcaaagaacgcttgatcgaaaaatatggcaaagaagaagcaaacaaacgtatctatgcaacgacagataaagcaaaaggtgccgttaaagttgaagcagatgctgaaaattgggaaacattcgtaattcctgatgatgttggcggacgtttctctgtcttgacagctgtaggtctattgccaatcgctgctagcggtgcggatatcgatgctttgatgcaaggtgcagcagacgctagtgaagcatatgccagtgatgaccttgaaaaaaatgaagcgtatcaatatgcagcaatgcgtaacatcctttaccgcaaaggaaaagtaaccgaattgctgattaattatgaaccaggaatgcaatacttctctgaatggtggaaacaattatttggagaatcagaaggaaaagaccaaaagggaatttacccttcaagtgctaacttctcaactgatttgcattcattgggtcaatatatccaagaaggccgccgcaacatctttgaaactgttgttaaagttgaaaaaccacgtaaatcaatcacaattcctacgcaagaagctgaccttgatggacttggctacttacaaggaaaagaagttgattttgtaaataccaaagccttcgaaggaacgttattggctcacacagatggcgatgtaccaaacttattggttaagatcccaacgatggatgcctacacattaggttatacaatgtatttcttcgaaatcgctgtaggtatttctggttacttgaatggtgtgaatccatttgaccaacctggcgtggaagcttataagaaaaacatgttcgcattgcttggcaaaccaggctttgaagagcttgcaaaagaattgaacgaacgtctataatttatcgttctaactaaaaagaaccagtcctccgatcattcttctgagggctggtttttcatttatataagcggatggttcagaataaggacgcttattcatttaaccataaaatgaccgtcacaatagggcattaatttgtggtctttaggaacagttaaccaatcaaggagtcatcaacgattttcctttaaaccaatcaataatgcgactgtcaagagaccaaaaatacatgtttggattactggcattctgctcatctcctttcctttatgttactaggactttctggaagatgcacgaacacaccagtcataagaagcgaacgattttgtcatcttgtctgcggaaataagtaggtgccaaatttatcataaaagcgcttgcataaatcggtatttttgttattatatttttagaaaagaagttctgaggtggtaagatgctagatattgaaattggaaatgcctatgtgtgtcaacctattggggcaaaaaaaacgctagtcggtgtaattgagaagctgtatgagcatacggctcttgtgaaagtgaccgattatgagatggaggatcaatccattgtattggagtgcaatcagcggatgttggtaaaatttgataagattaccgcagtggctgtggcttaataaaaacaagactggaactcgctaataaaaatgtattatgtcagcatgccgaaaagtcagcttgtaggcactgattcatctttattgactagagtccagtctttctttttagctggcgtgaattagccgacgccgatcacaaagttcagtagcttatctgagtaagtcatttcatcggtggactcactgagggtttggttcaaaatatccatccgatcggtaatgatgccgtccacaccgtagaactgcatccgactgatctcggcatcatcatttggagtccagacaaagatatctttatgatccgttttggcagatgaaacaaagttgcggttgatcgtactatattccatcgttaaaaaatcagcacttgttaatggagggccaacgatgttgaagggcatgatatacccagcagttagttccggagcctcttgtttcaattcttccactacattataggtcaagctttgtagaatatgttcatgttcggctagattttcacggtagcgttcaaggaatgaatggactaatgttgtcgtatcttttcgttgtgtcttgatttctactagcaatttctgattcaacgaattcgctaaggataaatagtcatcaaatgtagcaatcggagccgtttgtccattttcagagacggttaatttttgtgcttgtgccaaagttgattgctccggtttctgattgaagccagtcaacgctttaaatgaaaaatcgtgataaacaatgaaatgaccatcgctagtttgttgaacatccatttcaacgtaatcaggatggtagttctcactagtgaagcgcagtgcttctaatgaattttgaacgccttgaccattgctgacgccgcgatgcgagatcgtcaatggtcgagtattagcggcagaggtcagataattcatgttgtataaacttactcctaccccgaagaagacggctactacagtaatcaaagaggcttttagtcgttgaaaatttcttgctggcaatggttcttcactgaaccattgtggtatctcaggtaagaaaccttcatcgtccataaaatcaacaatgatatagaagatggcaacggtagacaaaatgatattcaacaacaaaacgagttgaaggagcgtcataatgaagactgctgaatacagcgcatagtcagcgaaaagttcttcaatgatcgcttgcaggataatcaaaaaagtaaatcctactgttgaaatgaataagatcgcgccgccaataaagacaaattggccaacaatcgcaaagaaacggcgtttcgttgtctgcaaactttctcgaatggcctgtcgaaaaggaaggtcacgtaagatcatttctggtaaagcaaaaatcacacgaatccctagataaatcaaaagtaagtagccaagaaccacggctccgataatcaatacacgattcgtaaagatgaaatccatgataaaagcagggattttcactttagagagcaaatctgagttaaaacttagcccgccaattggcaaaatcaaaaagaaataaaacaagaaaaacaaaaaggtcatggggcgtaatttgcgaatttgtaaaaatgtcattcgcaacagctgtcgcaatcggaccggctgctttttcttgatgaaatagacactcagaagcaggaatgtaaactcaaaaaaaactgctaataaaatcaacaacaagattagagagagcgagaatagaaccattggatgctctgtaaaaatactacctatattgtcgaaagataaataggctaatcccccacgacgcaggataaattttgttgaagaagaaagcagtgggataaccaaaaaaagcaagaaaccatgcattagcagaacatctcgaaaataagcatcgcttgcctttagaaaatcccaagtgttgatcaaactattttttagatatttcatgttgttcatcctaactctagactataaaaaaccgaactatcgtgtttgattcctgtaatgaaaggaatgaccaccatctatagttcgggaatttcctgtatttatttttgctattaagcccggcacttagccgcctaatagccctgttaaaaacgtaccgccataaatcaatgccatactatataagaaaatcgataatggttttgccaataaaatgatcaaagtgaatttcttgactgaaatattcgttagtccagccattaaacacaaggcatcatccggggctaccggtaaaaagatagcaagtgcaaagagtttttcaaatcgactttggttatccaaccagccaatatatttatcatatgttttatcactgatcatactgaggataaatggtttaccatatcttctgccaagcaagaagatgatcactgaaccaatactaatgccaacataattgtagacaaatccaagatatggtccaaaaatcaagacgccagccgcactggatatcccaccaggaatgatcggaattacaacttgtaaaatttgtagcagcatgaagatgattggtcccaaaataacagagttgcctaccaaaccacgcagtgcattaatatctttaaagacacctagattaatgaagtaaatcgttaaggcaatagatagccctaatcctataattgatatcgtattaatgatacgacgagaagtggcgatactcacagactttcatctcctttattcgtttctaattccactatacgtggtgtaattagaaaaatccagcaaaataaatgacattcgtcaaacaaatttgtaagatttgatacccttattataaaagaagaatagcaagaaggcattgtactaaagtctgaaataagaaaaatttagcaattcatgtacaaattatcacgagtgatcgataggcaagttgttttcatccttagttattgctttcattttttatatttatttcctagttgtctcctctttatcaagtcgtgctcttcgtttgttttgccaacttgcgatggtcttttcaacgacactcgtcatcataaacccgcccgcgattgctcctgcagtgatcaaaacaatcatgaggttttctaatcccaaaaggttatctcccaaggcaaattcacgaacagctttataagccggaccaccggggaccaagggaactaaactaggaatattgaagatgatcatgggcattttcttgcgtcgtgaaaaaaagatgctgacacagccaaccgcaaaggcagcataaaaattggcactaccaatgccatgacccatttcatgcagctgccaataaatcatccatccaacagttccagcgatcccggttgcaatcaatgcacgtttcggtatatttgttaatatgccaaaggtgacggtacttaaaaaactaaaacagacatgaatcaaaatggtcatgataaccccccaaacaaggtgaagactgtagcgattcctacgccgattgcggctgcagtaaagatagcttcagttcctcgcgcagttccactgatcagatggccagctagaatatcacgaaatgaatttgtgatggccactccaggaactaacggcatcacggcaccaatgatcaggttgtcaacatttcccgccaagcccccgcgaacagataggatcgctaagcagccaatcactaaagaggcgacgaacatatccaaaaagcggatatcgatcgcttttttcacccagagacctgtaatgaacccgatgctgccaatgaaaaaagtaacaatgaaatcagaccaattgccgccaaaaataatcattaatgtactgctgaccactccagcactcaatacttgtaaccagagaggaaagcttggtgtgacttgattgatctctttaagagatgcatacaactgcggtaatgtgatctgtttttctgcgaacgaccgggaaagccgattgacggccactattttctccaaattgatcacacgatcatgaacattttcaacttgagcgtagtgactgcttcgtaatcccataaagatgcctgtagcggtcacataactgatactattggcttcgccagcgttagcagcgatacgattcatggtatcttcgactcgataaacttcggaaccattctccatcatgatttttcctgccaagaggcaagtttctaacaataactcatctgtttcttgcattttaacgcctctctatcttgaaaagtaatcctcctattagtttacctttttcattccaattcaacaagagaagtatccggtgagttaaataactaataataaagaaaatatcttatttttttaaagcaaccattttatttaaattggtaaaaaacttcacaaatagcggtgtggatataattgtagaacaattcagacagttataagataacgaaatgagtatattgtttttcaatttggaaaatctcggttacaattagataaaggaaaagggggatttattgatgcgaagaaaggtctatacaagagaacatattttgaaggccgcgtatgagttgatcaataaagaaggatttggcaactttaccgcccgaaatatagcaaagcaaatggggatttcaacacaaccgatttatttggaatttgaaaacatgcaggatttgaaaaacactttagttgaagcggtcttcaaagatctttcagaaaacgtgtttcctgttgaacggactggtgataaagtcattgatttaggattaaactacattcacttcgcacaagaaaaacacaacttgtatattgctcttttcgtagatgactatggcggagggaaattgatgcacgatttttcgtctgattatttcaaaaaattgatcaagtccgaaccaaagtatgcggatctatcggaagaagcgattacagccttgcacaatggtgcttggatcgttgttaccggcattgcttcattgatgtcagctggaatcattacgccaacggaggaacaaatcattaaggtgatcgaggaaacgatcactgggattttagatagaacagacatttttatttttcaataataacgaatctgcaaccattttttcggatggattgcagattttttcttgactttttctgaaaaaagtagaaaataaacgttatggagagttggcagagtggtaatgcagcggactcgaaatccgccgacccggttcatcccggcgcgcaggttcaaatcctgtactctccttacattaacgctttgaagcgtttggcctatccttggtgataggctttttttgttttgtaagtaaagacatggggaggaggggcccgaggtatgagaaaagcatcgtacacgactcataaaatttaattaatgagttgattcaggcagcagtgagagcttaggaaacgagttttgataatgtcatgccattgcttctttttttgaacgaaatcgattaaactagaagaaagagaacaagaaagcagaaggtgataaaatgtctgagtttgaaaaagattatgtcatgcgccaaacgaaattagctgttaagggactatccgtttttttgaaggatgaatcagtagatgagatcatgcagttggatgaacagcagagtggacaaaagaaagagccagaagaggaaaagcagttggagtagctgtttaatttcataacaaaacaagaaagcacctgctattagtcttagcgaggtgctttcagtacgaatcggtatccttcatttggatgaactccttatgcagttttagtcaattcttgtacagcttgttcgatcgtcacaccagttgcaaaacggttagcatcttttttatcaaaaacgataaaaaggttcagttttgtatctagagtaactcgatattgtagttctgtgttatagaatgtcatagtcattctcctttcagtgttattcgtaacgaaaggcaacggttaagttgataacgaaattccatgatcagaataacacgttgcttggcgtctgtccaataataactgaatggtagaggaagtttactaaaatttattaaggagaacagaagttatctaaaaaaatcaaataacaaatttgtaaggaagctcctttagtatctgagtaaaaagcggtatgaagcggttttgcttgaaaaactctttttgttgggttaaataattaatttattatatttttttaaatttaattttattcaatttatggtaagataagatttgtttcagggaaaataaaaaaggaaaatgaaaatggatgtgaaaatatgtgcggaattgtaggtttcgttaatactaaagaccaaaaagccgaaatcattgaacagatgatggatcgaatcattcatcgcggtcctaatagttctggaaaattcattgatgaccaagttgctcttggctttcggcgtttatcgattattgacttagaaggcggtacgcagcctatttataatgaagatggaacgaaagtaatcatttttaatggtgaaatctataactttcaatcgttaagagaagaattgatccaagctggacatgtctttacgactcatgcagatactgaggttcttcttcatgggtatgaagagtggggaactgatttattgcaaagagttcgcggcatgtttgcttttgccatttgggatcgcgaaaagcaagaactttttggggcaagagatcatttcggaatcaaaccttattattacgcggaaatgaatggtacattcatgtttggttcagaaatcaagagttttttaccacatccagattttgaaaaagaattgaataaggatgccttaaaaccctatttgacttttcaatattcgccactaaatggcgaaacattctttaaaggcgtttatcgcttacaagaaggtcactattttacttataaaaatggcgtcatggacattcatgaatattgggatgcagactacagtcataaagaaaactatagcaaagaagattgggtccaaaaaatcgatgataccgttcaagaatcgattgctgcacacaaaatcagtgatgtagaagtagggtcatttttatcaagcggtgtcgactcaagttatgttgccgctgttctgcgtccagatcattctttctcaattggattcgatgacaagacctataatgaagcaattgaagctagaaaattgaccaagatgctgggattgaacaatacagcagcggtgattgatggcgagatgtccttcaacgcttttccactgatccagtatcatttggatgagcccgactccaatccgagttgtgtcccgctctactttttagctaatctcgcctcgcaacatgttcgtgttgtacaatctggtgaaggcgcagatgaattatttgccggctatgctgcttatggttggcatacgaactccaagatgattcgtgtatttgctcaaggattgaaaaaattacctaagaatattcgattcaaattaggccggacaattggtaatatgagaaacttccatggacgaattcatctctatgaagccaccgcacctgcaaaagatttctttatcgggcaagcgctggtctttgaagagcaagaagccactgagatattgcatccagactatactagtggaccatcagtggcggaaatcgtcgccccatactatgaaaaagtcaaagatcttgatgaagaagtcaacaaaatgcagtatttggatgttcatcaatggatgcccaaagacatcttattaaaagcagataagatgtcaatggctagttctttggaattacgggtgccattacttgatattgaagtcatgaaagtagctcagacgattccgacaaaatatttgatcaatcagtacaatacgaaagatgtctttcgtcaagcagcaaatcgtcacctcccaacagaatgggccaatcgggaaaaattaggttttccggtccctattcgagcatggctgaaagaagggactggttacaaaaccgtcaaagaactatttacagcggattttgctgcagaattctttgaccaagaaaagattttgcaattattggctgatcatcgcgccggtaaacaaggacttcaacggaaaatctggacgatctacactttcttgacctggtataaagtattcttcattgatgaaaaaattcctaaggcagaaacaatcatttacgaaacaatttaaaaacacgaggacagatgtagtccctctaaagtccattttcatacagactttggagaggagagacatcgaatcctcgtgtttctttttgtctttttatagggctaataaattttccaagtagtcagctaagccgtcttcggcattggttttatccgttacatcattggcaatagattttaattgtgcggttccatttgccatagccacaccccagccggcatattccaacatttctagatcattgtgttcatcgccaaaggcaataatatttttgggatcaatcttcagataatcggaaatcactgatagacctaatgctttatggaccccttttggaacaatctccaaaattgcatgaggaccgccccatgtacggacatcaaccgtgtcattgaattgatcgttgattcgtagagcaacagactcagcgaattcattttgtgttttgaccaataatgaagtcggatcagatttcatgttcttcaataagttttcttcagtaatactatcggaagaaaagaaacgctgatcaaagccttcaagttgatcgataaaaaaggtttcccgattttctgcagcaacaaaatctaagttcaggttctctttttgagccattagttcaaaagcgatttcttttgacacagagaattctgtttcatttgcccatacttgacgaggtttgtgtaccaaacctccattaaaattgatcataggtgtttttagggctaattgacgataaaactgatcactcattcgaaaaggacgaccggttgcgatggtcacataatgtccagctttcgttgctcgtgtcaaaacatcaaatgtccgctttgaaatttgggactctgtatttaaagtagtgccgtctagatcgatggcaattagttttttgttcactcgactcgctccattctctttttctagttgtttaagtgtaacacattttactgatttcacaagagatgaaagggggatggtaagtttctggaaaaaatcagcttcttgataaaacacgaacgttcggataaaatatttggtttttgttaatttttttattgtagaatagggggaattcgcctataatttgtaattgttcgatggaaagtgcaattattcttttcttttcagaaacactaactaatcttgtaggagtgaacgatttacatggaaaagtttttcaaattaaaagaaaataaaacaactgtttcaacagaagtgatggctggggtaaccaccttctttgcaatgagctacattctttttgttaatccttcgattctttccgcatctggtatgccttttcaagcagtctttctggcaaccatcattgcctctgtcattggaacgctggtcatgggactctttgcaaacgtaccgtatgcgcaagcaccaggaatgggattgaatgccttctttacctttacagttgtctttgggttaggttattcttggcaacaagcattagctatggtctttatctgtggtgtgatcaatattttgatcacgatcactaaaattcgtaaattgattattcatgccattccagagagcatgcaacatgccatcggtggtgggattgggatcttcgttgcttacgttgggttgaaaaatgccaatctattaagtttcagcgcggatactgcagcagttactggatcaactgttgatggtgatacgattgttagtgcttcatttaatggaggcatcgtgccggcactcgctaactttaataatgcaccagttatcttggcaatcattggcttggttttaacaacgttattagtggttaaaaacgtccgaggagcaattattatcggtatcttagggacaacgatcattggtattttgatgggtgtggtcgatttaagcacgattgattggcaaggaaactctttgggaagttcaattaatgaacttggaacaacttttggcgctgcgtttggcccagagggaataggttcattgtttagtgattctgctaaaattcctcaagtgatcatgacgattattgcctttagtctttcagatacatttgatactatcggcacatttattggaacagggcgccgtactggaatcttttctcaaaaagacgaagaagcgttggaagatagtaaagggttcaatacaaagatggacaaagccctttttgccgatgcaattgcaacttcgatcggtgcgatctttggaacatctaataccactacttatgttgaatcagctgccgggatcggtgctgggggacgaacaggattgacttcagtggtagtagcagctttgtttgccattagtagtttcttttcaccattgatttccgtggtccctgctcaagcaacagcgccggcattgattttagtcggtgtgatgatgctcgcttcatttgcggatatcaattggtcggatcttgaagaagcagttccagcattctttgcttcgatctttatgggactttgttacagcatttcttatggaatcgcagctggttttatcttttacgcaatcgttaaagtcgtaaaaggaaaattccgcgaagtatctccaattttgtgggtcgtaaatattctctttattttgaacttcattattttagctgtgatcagctagtaccaatcaataaagagcactgatttctggtcgtgcttttgacaatgaactatccaaactataacggattctttctttggtcgatgagctgctttatgtgggctgtaaagaacaaagaaggcgaaatcggttgtagtggggatagttttattttgtagacagatcacacaatcttctgtcttttttaattttactattttaaaaaatgcggtatagtttaagagaaagagggttttgacatgaaaattgattggaaacgaaatctcctaatttcttggattggctgtttttttactggtgcaagttttagtttagttatgccgtttattccgctatatattgaagagttgggggcgccaaaaagccaaatcgagctgttttcaggtctggcaatctcagtgactgcgtttgcagctgcaatcattgcaccggtttggggaaatttagcagatcagaaaggtcgcagattgatgatgattcgggcggctgctggtatgacagtcaccatgggctcattagcctttgtaccgaatgtctactggctattgattatgcgcttctttacggggatcctttcgggttatattccaaatgcgacagcattgattgcttctcaagccccgaaagaaaagagtggctgggcactaggaacattagcaaccggagctatcgccggaaacttgatcgggccttctatgggtggtgctttagcacagtggtttggtatgaagaatgtatttatcatcacagggatcgttcttttgatcacattgctgctaacgatctttttggttcaagaagatttcgcacctgttgaaaaaggggaccttctatctgtcaaagaaatttttggacaaatcaaaaacctacaactattgattggcttatttattacttcattgatcctgcaacttggtgtaacaagtatcagtccaattttgactttatatatccgtgatctaagcggcaatacagggaaccttttatttgtcagcgggttgatcgtatcgattgccggtgtttcagctattatttcttcgccaatattaggtaaagtaggggaccgctacggaaatcataaagtgttattaggaggactactgctttcattcctttgctttattccaatgggctttgttacgtcaccattccaattgggcgttctacgctttcttttgggcttctctactggtgcgttaatgccatcgatcaatacgttaatcagtaaaatcactccaatggaaggtgttagtcgaatttatagttacaaccaaatgttttctaactttggacaagtgcttggtccaatggtcggttcaaccgttgcccatagttttggctacccagccgtgttttgggtaaccagtgcgtttgtctttttgaatatttgtctttctacatttaatttccgtaaaaattttcataagcacgatctcagttgaaaagaaaaaaaaaccagttacaatgaaggtaactggtttttcttctattaatgacttgtcttttttggcgaaggtgcaatcaaaccaagaaggataattagtacacctgctaccaaagagatgattgaggtcaattggaaatcataagtagctcccgctagtgagctgcctagatagccgacaacttggcctaagataaatgtccaaaataatgttgctaagtagcgcatgacgacacctcttttctgcgtatcttgcttttcgactttagtttatcacaaaaaatttcaatgtaaagattttcacattttcatttattcttttcaaattagaaataaagcagaaacaaacggaattatcattttcggagggattttctatgtatcatcaattgacaaccttaagcgcgtattccttacttcaaagtacgatcaaaattcctcgttatattgctgctgccaaaaaagctggttataaagttttggggctggcagatcacaatgtgttatatggagccttagaattttatcagcaatgccaaaatgccggaatcaaacctgtgattggtgtattattcgattgcacgtttggcacgtccactatgcgttttccattgtatctttttgcaaagaatctatcaggctaccgattattgatgcgcctttccagtgagaaaatgatcaacggtcacttggatctatctgaatacttaacgttaccagatctgtttggtattttgccgcaagggcaaggtttctctccagatcaatcggaagacttggcacagctttctcgagcattgacagactttgtcgctcgttttgatcaaaagagtcttttcctgggtgttcaaaaagcagcggcaacgccagaaagagagtggtttcaacagcacggtcttgagctgtgcgcttatcaacccgtagcagcactggaacaagcagaactatttgctgttcaagtcatggaacatattaagaacggtactcagatcgaagattttcgtaaagcgaaggaacaatcttccgaaacgtattatttagaacagcctgcggaactgattcaggcatttggagagaattcagaagcattggtaaataatcagcgaattgcagaagaatgtactctgacgattcctctccatcaacgtttgctcccgcatttccctttagaagaaggggaaaatgcggctgattttcttagaaaactgtgttttgaaaagttgtctgaacgtattacgcaggtcacagatatttaccgtcagcgtttggattatgaactatccgttattcatacaatgggatttgacgattactttttgatcatttgggatgtgatggattttgctcacaagaacgaaattgttaccggcgcagggcggggctcagcagcaggttcattagtagctttcgtattagccatcaccgatgtcgatccaattgaatatgacttgctgtttgagcgtttcttgaatcccgaacgctataccatgcccgatatcgatttagatatacctgataacagacgtgatgagattttgcgttatgtccgtcaaaaatatggtcaggagtacatggcgcaaattgctacttttggaacgatggcggccaaaatggtgctgcgggatgtttcacgagtgtttggtttgtcacaaagcgaagccaatcgctggtcaaaagccattcctaacgcattaaaaatgacattggctttagcttatgagcaatccaatcaattacgagaattggctaccttcaatgaacgaaatgaaacgatgtttgcagtggctaaggtactggaaggattgcctcgacatgtttccacccatgcagctggtgtggtgatcagcgacaagaatctcttggatctagtcccccttcaacaaggaagtgatgagatcctcttgactcagttcacaatgaatgatgtggaaacagtgggattgttaaaaatggattttttaggattacggaatctttcaatcattgacaatactttaagagggatcaagcgagttacaaatgaaacagttacccagaaagctattcctttaaatgacccagctgtgctgcgactatttcagcaaggcgatactgccggaatctttcagtttgagtcagcggggatcagaaatgttttgcgaaaacttggacctgaaagtatcgaagatatcgcagccgtcaatgcgttgtatcggccaggacctatgcaaaatatcgatacgtttattcgacggaaaaaaggacaagaaaaagtcgtttatccggatgctgctttagtgccgattttacaaaatacttatggaatcattgtttatcaagaacaaatcatgcaagttgcttctaaaatggcaggcttttctcttggtcaagcagatatcttgcggcgagccatcagcaaaaagaaaaaagacgtcctagatgaagaacggcgccattttgttgaaggagccgtagccaaccatttttccgcggagaaagcagaagaagtttacgattatattgagcgttttgccaattacgggttcaatcgttctcatgcgtttgcctactcatttatcggcttccaaatggcgtatttaaaggtacattatccagggccattttttgctgcattattgcactcggttaggaataatccaggtaaattaaaagaatatttgaatgaagcgactcggtatggtgtagcaatcttaccgccgtccatcaacaagagtggctatagtttctatcttcaatcggaaaaacagattcgttttggctttagcagtgttaaaggaatacgtagagacctgattcaagatattttagatgaacgaaaggagaatggaacattctcctccttagatcaattcctgttgcgcttgcatcaaaagaataacaaatggctgaaagaagattatatccgtccgttgttaagtattggtgcgtttgatgaattggtcactaatcggaagcaagcacttatccaattagaagggaaaatccaaaatatcacctatagtggcggcagtctcgatttgttagagacaatggctctcaaagaagccgaagtcgctgattatgacttagagcaaaagttagcgttggaagaagaatatctaggggtttatttatcagggcatcctgtccaacaatatcagaagctgcaacagttgaagcagacgatagcaatcgctgacttagttcccaacgaacgtgtccggatactattttatgtgcgtcaaattcgagaaatccgtacaaaaaaaggagagcaaatggcgtttcttgaaggaacagatgctagtaaagaagtctcaatcactgtttttcccacattgtatcgtcacatacgatctgacgttgcagaaaacgtcgtcttgtatgttgaaggaaaagtggaagtaagtcgttacaatggtgaaatacaactgattgctgataaaatagagctagctgaaaaagcgcaagcacagctaacagatcaaacgtgttatctgaagatcacacgtgatgttgagacgaaccatttgcaagaattgtcgcagttgctgagaaagcatcgaggccgggttcctgtggtgttgttctatgaaagcaacgggaaaaaagtgttgctgacggaagagaactggctaaaaaaagacgaagaaatggaaagaaagcttgggcacttgttgggagaggaaaatgttgttttcaagtaattttccgaaaacgttaaattttacttacacttttttcaactttttcccactatttcaagacatttctctggaataatggtaaaatactactcgtggttattacttgaaaagtatcaaataagggagttccaattccctaaacaaatctactaatgaggtgaatggataatgaaacgcattggaattctaaccagtggcggcgatgcgccggggatgaacgcagcggttcgggcagttgtaagaaaggctatctttgatgggctggaagtatatggaatcaattacggctatgctggtttggtagctggagatattcgccgtcttgatgtggcagatgtaggtgacaagatccaacgaggcggtacattcttgtactctgcgcgctatcctgaatttgcgacacaagaaggtcagttgaaagggattgaacaactgaaaaaattcggtattgaagggttggtcgttattggtggcgacggctcttatcatggtgcgatggctctaacacgccatggttttccggcgatcggtattccaggaacgattgacaatgatattcctgggacggactttactatcggttttgatacagcaatcaatacagtattggaatcaatcgaccgaattcgtgacactgcaacttctcacgtccggacattcgtaatcgaagtaatgggtcgtggtgcaggtgacattgcgctttggtcaggagttgccggtggggcagatgagatcatcatcccagaacatgactttgatatggccgttgttgcgaaccgaattcgtgaaggacgggaccgcggtaagaaacactgcttgatcgtcttagcagaaggcgtgatgggcggaaacgaatttgctgataaattatctgaatatggcgatttccacacgcgggtatcgattttaggacacgttgttcgtggcggatcaccaagcgcaagagaccgcgttctagcaagtaaatttggtgcttacgcagttgagttgcttcaacaaggcaaaggcggattgtgcatcggtatcgaaaacaaccagatggttgctgcagatatcatcgaaacgcttgaaaacaatcgtcacaaaccagatatttctttatacgacttgaacaaggaaatttccttttaagtttaggaagtatgaaacgcaacagtaattttgtaaaaaaagcttattaagctattttaaataaatgaataggagcgtttagtaatgaaaaaaacaaaaatcgtcagcacattaggaccagcaagtaatagtgtagaaattatttctgaactgatcgaagccggtgcaaatgtcttccgtttcaatttttctcatggagatcatgaagaacaattaggacgtatgacaatggtgcgtgaagcggtcaagaaaactggtaaagatgtagggattcttttagatactaaaggagcagaaatccgtacaaccgttcaagacacaactgaagcagattatggtcgtgccggctatatccaattcaacgttggtgaccaaacacgtatctcaatggacccagaacacaaaggaacaaaagaaaagattgcagtgacctatcctggattatttgacgatgtatatgtaggcggccatatcttatttgatgatggtttgatcgatatggagatcatcgaaaaagacgaagcagcacgtgaattagttgttgttgttaaaaatgcaggaatgttgggttctcgtaaaggggtcaatgcacctggcgtatcaatcagcttgcctggtattactgaaaaagatgctgacgatattcgttttggattagacaatgatatcgacttcatcgcagcttcattcgtacgtaaagctcaagacgttttagaaattcgtgaaattcttgaagaaaagaacatgactcatgtacaaatcttctctaaaatcgaatctcaagaaggtatcgacaacattgatgaaatcatcaaagtttctgacggtatcatggttgctcgtggagacatgggtgttgagattccagcagaagaagtaccaatggttcaaaaacgaatcatcaaaaaatgtaatgcggtaggtaaatcagttatcactgcaactcaaatgttagaatcaatgcaacaaaatcctcgtccaacacgcgcagaagcttctgacgttgccaatgcagtctttgacggaacagatgcaaccatgttatctggagaatcagcaaacggagactatcctgtacaagctgttgcaacgatggctcgtatcgatatcgaagcagaaaatgctttagcagaaatgagtactttccaaatcaaccaatttgataaaactgatgtaacagaaacaattggtctttctgtggcacgtgcagctaaaaatcttggcgtaaaaacaatcgttgctgcaactgaatctggctatactgcgaaaatgatttcaaaatatcgtccagatgcagatatcttggcagtaactttcgacgaacgtacaaaacgtggtttgatgttaaactggggtgtttatccaacagttgctgaaaaaccttcaacaactgacgaaatgttcgaattagcagctaaacaagctgtggatcttggttttgccaaagaaggcgatttgattttgatcactgctggtgtgccagttggagaacgtggaacaacgaacgtgatgaaaattcaaatgatcggttctaaattgcttgaagcacaaggaatcggtgaaaaatcaatcgtttctaatgccgttgtagccaacagtgcagaagaagcaattgctaaagcaaaagatggcatgatcttagttgttccaacaacagataaagaatatatgcctgcaatcgagaaagcagcagcacttgttgttgaagacggcggtttgacttctcatgcagcagttgtcggcattgcgaaagaccttccagtgatcgttggggcaaaagatgccacaacaacgatcaaagatggtgaattgattactgtggattctcgtcgtggaatcgtctaccgtggagaaacaacagctatctaatcttctttcgaaagattgattaatggaggcaacaggctcgtgcataagtagcgagtctgttgtttttttctctaaaagcaatcacttttttgtgcgtaaaattacagctgtagaaatgaaaaaggtgtcaagaaaatttcattgacaaagggaaataacccctgtataattgcttttgttgcttaggggtgataaaaatgaaatggtctttattggaattaaaaaaataccaagagacaccgctaatgttcgacgaaacgttgaacttaaaaaatcaattgataaaacgcgatggacagatcattgatttgtctcctgtgaaaatcactggcatgatgtctgttggaaaacatgaatatctcctacattatcgagtggagacaaccatcacgttaccttcaacacgctcattgactccagttgctttgccaatggattttacagtggatgaactcttcatgacaccagagcaatttcagcggcgagatgaaatgattccagaagaagatgtcttgatcattgaaggtcagacgatcagtttggatgattcagttgctgataacctattacttgcgattcccatgcaagtccttactgaggaagagaaaaatagcacagaaatgccgtcaggaaatgactgggctgttttatcagaagaagactatgcaaaccaaaaagaagcgcaagcccaacaaattgatcctcgtcttgcaaaattatcggaactgttcaatgattcagaagatgataacgcgtaggattggaataaattgcagcctcaaggttgctttcatttacaaggaggtgtagcaaaatggcagtaccagcaagaagaacttctaaagcgaaaaaagcaaaacgtcgtactcattacaaattgacaatcaacggtttgaacgaatgtgcaaactgtggtgaaatgaaaaaaagccaccatgtatgctcaaactgtggtcattacgatggaaaagatgtagcaacaaaagaagcataatccttttttacagaaaaagggatttcaaaatcctaaggctaaccatggagccttaggatttttctttttgtttcagattagtttcatgaaaactagaacttttctgaaataattcttactctttgaaagagaatagttcaaaacaactatcttttgcgctataataaaacagataactgaatcttaggaggatgagtgatgacaaaacaacaaatcggcgttgtcggtatggcagtcatgggaaaaaacttagcgttgaacattgaaagccgcggttattcagttgccctattcaaccgtacaggatctaaaacagaagaagtagtaaaagaacatccagataaaaactttaaagcaacctatacgattgaagagttcgtacaatcgatcgaaacaccacgacgcattcttttgatggtcaaagcgggttttgcgacagacgcaaccatccaagaattattgcctcatcttgaaaaaggggacatcttgatcgatggaggaaacacattcttcaaagatacgatccgtcgtaatgaagaattagcaaattctggtatcaactttatcggtaccggagtttctggtggagaagaaggcgcattgaaaggcccgtcaatcatgcctggcggacaaaaagaagcgtatgagttagtggctcctattttggaacaaatctcagcaaaagcagaagatggcactccttgtgttacctacattggaccaaatggtgcaggacactatgtaaaaatggttcacaatggtatcgagtatggagatatgcagctaattgctgaatcctatgatttgatgcaaaaaattctagggctatctgtttctgaaatggcggagatcttctctgaatggaataaaggggaattagatagctacttgatcgaaatcacagcagacatcttaacacgcaaagacgatttaggtactgggaaaccaatcgttgatgtgattttagatgctgccggcaacaaaggaacggggaaatggacgagtcaaagtgcattagatcttggtgttccactgccgttgatcacagagtctgtttttgcgcgttatatttctgcttataaagaagaacgagtgaatgctagccaagtcttaccaaaacctgaaggattcgaatttacaggagacaaacaagaatttgttgagaaaattcgggaagcattgtatttcagcaaaatcatgagctatgcacaaggttttgcgcaattacggaccgcatcaaaagagtatgattggcaactgccatttggtgaaattgctaaaatctggcgtgcaggttgtatcattcgtgcgcaattcttgcaaaaaatcaccgatgcttatgaaaaagatacggatatcgaaaacttattgcttgatgactatttcaaggaaatcacaaaacgctatcaacaatccgttcgtgacgtcgtagcattggcagtccaagctggcgtaccagtcccaacattctcttcagctattgcttattttgattcttatcgctcagatcgtttgcctgcaaacttgatccaagcacagcgggattatttcggtgcccatacgtatgaacgtacggacaaagaaggaatttaccactactcttggtatgaggaagaataagtcgaacaattgagaacaaattaagagaatgaccgaacagtgagaactttcggtcaatctcttttttattttttagatacatgataaaataaagcagatagtgtctaactatatgcagaataaccgataaaggagctctaactaatgagtaatattctaatcattgaagatgaaaagaacttagctcgattcgtggaattagaattaaagcatgaaggctataataccgaagtacattataatggcagaactggattggatgcagcgttgaacaatgaatgggatgccatcttacttgatttgatgctaccagaactaaacggattagaagtttgccgtcgtgtgcgccagaccaaaaatacgccaatcattatgatgacagcaagagattcagtgatcgatcgggtctcagggctagatcacggagcagacgattatattgtgaaaccctttgcgattgaagagctactagctcgtttgcgtgcgctgttacgtcgaatcgacattgaaggagacaaaaatgttgccaagcaaacgacgatcacttatcgtgatttaaccatcgagaaagaaaaccgtgtggtgcgtcgaggcagtgatgtcattgaattgacgaagcgtgagtacgagttgcttcttactttgatggagaacgtcaatgtcgtcttagcccgtgatgttctgctgaacaaagtttggggttatgaaacagaagtagaaacaaacgtagtcgatgtgtatattcgttatctacggaataagatcgacgtacctggagaagaaagctatatccaaactgttcgggggacaggatacgtgatgcgttcgtgagcttaaaaaaaagaatgaaaaaactaaaagaactgaaggggccttctttgactgtgaagtgggccttcgcaagttctttctttatatttgttgtttttacaatttttgcagtcatcacttacaaaacgtctatcaacctgcttgtggctaaagaagaaaataacgtggagcgtacgatgtcggaagtagcttctaggttagccaattcagaccaagaattgacattggtgcgtacctatcgcaatttaactaagaacgatagtggtgatacgagcatctacgaccgaacttcaacaattgatgggaacttaatgaagatcgactcgtttatttccgagttaggtcagtctcctttgagcttatttgtttataatctgaatcaggaattgattttcaaaacccatgaaaataatctttctctgatcgatgtgcagcgaaagccgcccacgatcgtgacattggacaatattacaggctttttgtcgatccagccaatctactcaaaagaaacgagagaaaaaattggttatgctcaaacattttatgaactgacctcattttatgaaattcgcagtaagctcttgttaacgctaatcatacttgaagtcgtttccttgattctcagtagcgttttaggttttttcttatctgcttatttcttgcagccactgaaagttttgcgggatacaatggaaaccgttcgaaagaatccccaatcgaccgtgcatatgcctgaactgaatacaaatgatgaattatctgatttggcagacatctttaatgagatgctcgaccgtatgcggctatatatcgagcagcaagaacggtttgtagaggacgtttctcatgaattacggacaccagtggcaatcattgaaggacatatgagcctgttgcagcgctggggcaaggacgatccagaagtattagatgaatcgcttgcagccagcatgcaagaaatcagtcgaatgaagacacttgtgcaggaaatgctcgacctttccagagctgagcaagtagatgtccactatgcgaatgaaacgacaaaagctaaagaagtcgtataccaagtatttaataattttaaaattctttacccggaatttgttttcacattggatgatgatctttaccacgaattgactttaaaaatttatcggaatcatttcgaacaaattattattatcatcttagataatgccgtcaagtactccacagatcgcaaagaggtccatttatctatttcttctgatcgacaaacgtttgagattgcaattcaggattttggtgaaggaatcagcaaagatgacttggataaaattttcaatcgattttatcgagtggataaggcgagagcaagaaccaaagggggaaatgggttaggactatccattgctaagcaattattggaaagttataaagggcgcattactgcagaaagtgtgattgggcaaggaacgatttttagaatatatattcctgtggttcaatctagtaaggatgttttgaaatagcgcagatcctctgcgaagaaaccagctggttgttgtaggttagcgacaatcagctggttttttctttataagggatcttacttaatggacagcgtttctgcttgttcatataaacaggaacgattgaggaacacgaatagttataaaacgcaattattgctataaaagcgaacgatgagataaagaatagaagaaagattcggctaaaaaaaatgttgagaaaaagctttgttttttgttgatttttcgcagtagaattgctatattagtatttgtctttgtgatagtcactgtttaaatctttcaaatattttttcaaaataaatgttgacgaagatcaagacaaatgttattataacaaagtcgtcagaaagcattaggtaaaaaaacttaaaaagttagaaaaaactttcaaaaaagttgttgacacaaagctttcgagatgataagatataaaagtcgctgagagataaagagtgattaaataacaatcacttgaaaaagcttttaaaaaaagagttgacattcacttgttgatctgatatgatttaaaagttgctaacgcagcgcagtagacctttgaaaactgaacaaagcaagcaaacgaaccaatgtgtagggcgcttcattatatgaagcaaaatacatgcaagcgatagctagcaaagttaattttannnnnnnatattcagtttaactcaggagagtgtaaaatattttgtgtaaatagaaaaaaggaagtcccttctgtagaatagagttaccacaacacattcacagaaaagaggacttccatatgaacgattttactacagaaattctaaagactctagcgaacaaaggcgatttgaatgaattattccgtgtccatttggaaaaagctgtcaatacgcttctcaaaacggagttaacggctttcctcgattacgaaaagtacgatcgcattggttttaacacgggtaattctcgtaacggctcctatgaccgtacagtcaagaccgagtacggggaacttcatcttcagattccgcgcgaccgcaacggcgagttcaagcaacagactgttcctgcttatagacggacgaatgataccttagaggagaccgtcattcacctcttccgaaaaggtattaccatgtcggaaatcgcagacttgattgagaaaatgtatgggcatcactacacgccccaaaccatgtccaatatgactaaatcatttacggaagaagtcacttcatttaaggaacgtgagcttcatgaccgttatgccgctatttatatggacgcaacctatatccctttaaagcggaaaaccgtcgccaaggaagccattcgtatcgcagttggcattcgcccggacggttcaaaggaagtgttgagctatgcgattgcaccaactgaatctatcacgatttgggaagagattttaatagacctccaggaacgtggcgtgaaaaacgtcctccttttcatcacggatggcttaaaggggatggcaggggccgtgcagcggttctaccccaaagcccgttttcaacattgctgtgtgcacgtttcccgtaatatcagtcacaaagtgcgtgtcgatgatcgtaaggaagtctgtgatgattttaaaatggtgtatcaagcctcatctaaaaaggcggcattggaagaacgtggtgcttttgcggaaaaatggaaaaccagctatccaaaaatagtggaatcgatcctttcgaacgattacctgctcactttctatggtttctcattagccatacgcaagactatttactctacgaacttgattgaattctttaataagcaaatcaagaaatacagccaccgcaaggaacagttccaaaatgaagagtcgatggaacgtttcttagtctcgtcttttgatactcacaaccaaaaattcctaggtcgcagtcataaaggtttccaacaggccgaaggcgagctcgaacaaatgctgagtcaaccgatggagaattagaaacaatctacagtagggaagaaccatttacacaaaattattgacgctccctttgtcggcatctacttgaaaaagaaagtaagaattatgccattcaaatccaacattacttgcatacattttctcgtaagccgaaggctctcaaacattcactggctcttcaggggattccgagattacatcgttgttttctccaatatcatcaaaatgatcccaagcgatttatcgaacgtttaaccttctaccaggcagtcccgttggaagaactggtgcagcatctagagtccgatgcacttgaagaannnnnnnnnnnnnnnnnnnnnnnnnnnnnnnnnnnnnnnnnnnnnnnnnnnnnnnnnnnnnnnnnnnngaagttccccgtacgtggtcttgactgtacggtcataggagccgttacgagaattacccgtgttaaaaccaatgcgatcgtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacacaagggacttccttttttctatttacacaaaatattttacactctcaaaataaaataagggagtaactttctctaaccaaaagttactcccttattttattttgttatcactgttgaatcatcatttataagtgaacgtaaaagataatagatacccaaaaacagaaagaaaaataacggtaatacacggagtaaaacaaacggagtttcaaaaatgaacgctttccaaaaccacataccctccatttcccataaaccttgggtaaaataccatgatttaaagggttctgttgcaaagttttccaaaaaatctattttagtgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttatcgttgggtgcaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgctttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaagatatttggagttcagagagggcgcgtttgattttcaaacttcgcaacagaaccaattcaagttacgggcatacttccaacggtttcccttaaaagccagaaaacgtgtgacacacatcgtgatggatatgaatgcctcttacgatgcagtgacgaaagaagtctttccaaatgcgcgactctctatcgatcgcttccacatcatccaacaaatgacgcgtgcatttaatacccaacgaattcagacaatgaagcagctaaagaaaagtgatccacaagcgcaaaaaaattaccgaaagctgaaaaaatattggcgaacaatcctaaagaaaaatacaaaactaaactacacctcttttaagcaatttcccctcttccaagggaaatacatgacggagtcggaggtgcttgattacctactctctatagataaccaactacgacaaagctatgaagtctatcaagagttattagctgcttttgatgcaaaagattttactgaatttttcaatctcattgaatcattgccacattccttgaatgatgggtttaaaaaggcaatttgttatctgaaaaagcacacagaagcaatcacaaactccttaaaatatccctattcaaacggaaaattggagggaaagaataacctcatcaaagtaatcaaaagaattgcttttggatttcggacttttcgtcatctccggatgcgtgtcctgattcaacagaacatctgtgaaatcatttaataacgcaaaaaaggaaatgccgaagcatttcctaacatacgatttgagcaaaacaatagcaattgacaaagaacctaaataatttccataaaaaacgcactcctttccaataattttaggaaaggagtgctttatttcatataaaatcaattttttatacacatgctcattggctatatttcagggttctcgagaaataaagcaagccagtttgacaatcgacataacgttcttttccaaattgctggcggctttttttcctttccaccattagtatactacagtttctgcctttcatccttcagggtgaatgagcttgcgaattcatgtatgtttgacaaagaacctctttttctaaaaatagaccgacaaagtactgcctagaatcaacccattttttaaaataacgtacgatttttatttagtggcacgttatgagagtctctcgttcgtttttctgatctttttattgactcaactgcctataaaacgacggaaaaagtatttcatgaataattcaggtacttataatcagtacaataacctgataaaacccctagtttaactagggaatccgaagctaagccctcttttccaaacccagagagaagaattaaccctgcgaaagcaattaatttcattagttcttctgaatgattcaattgacttcacttactcagtatattaattggattcatctcaatcattttattaaaagttggttcactcattacttttaatagttcttctttcaaacttgttaaaatataggtaagcccaggcgttcctccataagttggcaaatatttttttcgtcccatatcacctgaaagacaaatctgattttcataacccgcatcaaccagtcgtttaattaattggacgcggtctgcatcatgattcgccaactctcggccaatatgatctatacaaatacttgctcccgtttcacagatttgagctaaatagtgaaaatctttagttaaatctacatgactcaaacaaatattacttgctttcgcaccgttttttgttaaacaattaatttgctccagtcccatcgtccccccatcacaatgcgtaataatgggaatccctgtttttttttgtacttgaccggctatggctagtattcgttgttcagccaatgtaacctcatttttactcgtacctactttcattgctcctggcaaaaggttttgtgaagtgactccgtgagttatttcggaataaagcaactcaaagatctcatcatcattgagcgttgtcaaccattttggctgaaactcttccttatggaatcccgtaacaaatgctacattcactccggtagcttcagatatcattttcaaagctaacggatttcgtccataattaattggtgtcaaatcaacgatagtttttccaccagcttgtttaaaagccataacttccgcaatactatgataaatatcatccaaggtataatcttcatactttcttaactcattaggaatgacatataaatgttcatgaataaatgttgtacccaaagactcagcttcgattgggcctgtaaccgtattgatcatgcactcatctcctaccattcagcgattgtaccatcataatttttccacttaggattggtccaaactaaaccttcttgtgcaatttctttcactcgatcttcgtccatttctaaccctaaacctggttttgtcggaagatctacgaagccatctttgtattggaatatctctttattctttacaaaatctaacaaatcaaaccctttgttgtaatgaatacctaagctttgttcttgaataaacacattaggtgtacaagaatcaacttgtaatgtagctgctaacgcaatcggtccatatggtgcatggggggcaactgctatatcataagcttcagccattgcagcaatttttcttgtttctaaaatccctccacataaagctacatctggttgaatgatatcaatcgctccctgttgaagaattgatttaaattgccatcttgtatacaaacgttcacccgttgctagtggtacagcaactgcattggctacttcactgaaatgttcttcattctccggcaaaaccacttcttctaagaacattggatgatagggttccagtgcttttgctaaaaccttagccattggtttgtgaacacgaccatgaaaatcgacaccaatgctcaatgtatctccaaaacgttctctaattgaagcaacacgttccactacttcagctactttttcataagaatcaatgtagtgtaattcttctgtcgcgttcattttcacggcggtaaacccacgatctactcgatcttgtgcctgctctactacttcagaaggacgatctccaccaatccaagaatatactttgattttatcacgggctgctccacctagtaattcataaactggaacatttaaggctttccctttaatatcccataaagccatttcaagtccagagacaatcgttccattaataggaccacctcggaaaaatgaacgatgcatttcctgaaacagacgttcaattgcaaatgggttttgaccaactaagaatcgatttcctatctcataagctcctgccacaactgtttcagtcttagttccagaaatcatttcaccccagccttcaataccttcatctgtagatattttgacaaaaatccatcttggttttactttatagactgtaatttttgaaattttcactgtatgccctcctgaatattagaaaatatttgaaataaactcagcaatcttcattaaaatgaaaccaataatgtgtgtacctgcatcttcggtagatatttgtgtcattcctgctggtaattggaatcccccagccaaagctaattgtgtatgtatgccggctaaactagtagcaattaaaagcacacaagctgttataatcgtggtggaaagtattccgcgaataatatttccttttgaaaaggcgaccggccatgcagatagccacattgcttggtaggcaatatctgaaataggtaagagtttgttacctggtaaaatagcagccaacactaaggtaatcggaaccatgataatacccgtagcaatggcacttgaattagcaactgtcaacgcagcatccacacccattgtaaaattgtttcctggaaattttacattcaagaatttcttaacagaattagcaaagggtaataatccttccattaaaatttgcatcattttaggtgttagaaccattgttgcagaagtactcattcccactatcaataccttatcaacaggttcttttgctaataacccaataaccaagccgatgacaaatcccataaacataggctcaccaacaaaaccaaaccgctcttgaattttttcaggacgagcatctaccttatttaatccaggaatgcggtcccacaatttgttaagtagccaagccaagggtgcccaaccaactgagttcgcagtcgggaaattaaccccttctagttcaaagtaatcctctactaacggcgttgtccaatcagcgagtttaaaactaataattgcatcaatcgccccgaagattaccgccaatataatatttttatccgttgcataataaaccaaagcagctacaaaaatatagtgattataactccagaaatcgaccattactgtattggtctttttaaaaatcagcatcaacacattaatacccaaaataataaataccataactgctgctagaggaaaagaccaagtggctgctgcacgagctggccagccgacatccataatacttgtttgaataccccaatttttgaccattaactgaacagatggacctacctgtgaaataaaccaattaataataatatttacacccgcaaaaccaatccccacagtcaacgctgattttagtaatgtatttagcttaattctaaaaaataatcctaaaatcaagataatgataggcatcataatcatcggacccaaacttgagatccagtttaacgcatcaatgacaatattcatttttcaccctcctagtcaagctctttcaatgcttctaacaccaaagattcagatttttcttcattcactccagtaacaaatggtgttccaggtataactttaattcctttggttacattttcttgtaatttccctgtaggaacgataaagtcaacttgatttgattctaaagcacctgcaacttctgaaaattttagttgcaaaattcgaggttctggtaatccatttgtttttgctattttccgaattttattagctgccattgtagatgtaatcattgatgatgcacatgcgacgataattgtttttttactcattgtatttccctccaatttattgattaaatgcagttaaaacttctgttttactctttgcttccataattgcttgtaagaaatcctgattggtaactttactcatcaactccttcaataattgcggttgcttatcgggactatcgaataaaaggtgaataataacattcactgaaaccatttcttcgggatcatccattcgctgaaaatgcaaactatctttaagaacggatactaaaatagcggtaacatttgataactgataatctgtatgtggaattgcgattgagcgttccccaatatatagccccgttggataagttgtttctctcttagtgattgactcgagatatccctcctttaccatgttttccgtcatcagtttctttgtaatcttttgaaagtattcttcttggtttgaaaaactttgatttaacaaaatatttttttcttctaatttaatgagactcatcttcttcacttcctgcttcagctagtttatctaaatatgattgaattgattttcgaatagcttgcccattgcggttttgtatatcagctttttgaaacatgcttgatcctaccccaaagtacacaactcctgcttttttaaaagccgcaatattatcaatcgtcactcctccaactgccattaaaggccgtataccaaaaggaccggccagttgtttaaagtaggttggccctacagtgactgctggaaaaacctttacaatatcggcaccttcatcaaacataacttgaatttccgatggcgtaaaagctgatggcacagttaccaccccacgttctttagccaacgaaaaaattggtgttgaaaatttttttggtcctaataaaaatttcgcaccaccagcaattgcttgatctgcttgtgaaaatgttaaaactgtccctgcaccaatcaataattgttgcccaaattttttgttgccttctgtgatgatacgtgcaaagtcatcattattggttgttacttcaattcctaccgaagtgttcatcgcagccaattcttccatgacaaacatcgcctcttcaaaactatatcctcttaaaatgatggttaattcaggaaaattcgttattgacatattgcttcctccttaaaaaattttttattttttttctcacttcatcttccgtcgtgcaaagaagtatttcttgctgatattcctcgtccttagaaagttgtagtaattggttaatcgcaagtaaataattttccttctttccaattgcaaaaggggaaataaaatggataggcctatttccaggaaaaataattggatcaactgatataagtaacgagcaaccgcccttaattaccccattttctggcgatgaatgtggaatagcaatacgattattaagaaaataataagcctcttcatccgccatttgactcattaaaatagtctgatagttctgattaattacctgctcctttaataaaggctgacaagacaattccatcgcgttctgccaagtaagttgtttcgtagatacaagaataatcccttcagaaacaagcaattccacaaaagatatcttttgtgcctgtttactttgacgatctagatatattagtgaatttgcataattaattaaaaatctctcaatatcagtttgtagactttcttcattttgaacagcagagtaacgcttaataatttcagtaaggttcctagtctctttgctgatattattcgtagaaaaatcaatgagtacacggttccgcaagcggtttttttcttcttcgttcataatcggttgtataatatataatggaatttcacttttcaatggttgattgctaaaaatcaaatcaacatcttcgacaaacttatccatctctctgaccgaagaactagcaacaaactgaatatctggaaaaatttctttcaatgttttcgccattacattggccataatcaatccattgctacatacgacgattgccttttttctaacaggtgtttcgataatagaagaatttaatagctccgaacaaaaataaacagaaatcaaatataattcagtttcaggaatcgtcttacgcaaaaatgcttccaaaggtacaatggattctttaacaaaattaagtaccgcactaacttcatggttttccttaacaatttcagctaaatcatctatttcaaatggtaattcgtagcgaattcgatagattgcaggtcgtaaatgattcatcaatcgattggtcaactcttctttattactaatccgaatagctgatttactttgaaataaggtaatcatctccataattacttgatagattcttgaatctaaaatttcaaactcatttgaaattgtattgaatgataaaaacagaagcgtcaaccattcataatctatagctatctcagcatgttgataatgttgatcaatgcagcttcgaatcatttgaaactcatctaattcctgtaaatcataactaaaatcaatctgtcctttcgtccttcttttaaaactagaaagtgataaacctatcaaataataaagtttggttagtgaattatcagaaaatttcaatttaaaagtttgttcgtaggtgtgaataaaaaaaccaacaaattccctttcttcagaaaagagtgactcaaaacggttaactgttgcatgcctttcaaataaataattgaaaacttctaagagcaatgtatgaagctttgccatgcttgattcaatcatatagccattttggggatcaaatatcaaagtgtagtctggtggcaactctttttttattttagaaaagtcgtttctagccgtatttttactgataccaataaacgccattatttcttgggttgtcacttttttggggttggctagaataaataacagttccgaatatcttcttatctcactataagccaaatcatcgtttatatattcaggaatcgcaccttctttaaaaaccattgcttgattcatgtatatcaaaagtttttgaagatcattggcttcatataaccactcccctgagttacttcgctttatcagactcaatccatgaagggataattcatcattaattttttttatagagtaagttatctgcctagtcgaaaaatgtactaatgatttcaattgttgagagtttgtcacatgtgatcgtacaatggtttctaacagttttaaatcttttgtattcacattcatctacctccctgagttaaatataaccgcttacagtattaattggaatatccaaaatttgtcaaaccttggcttaaatcagacaaatgacaggcacttctttaattttttatcttatgcaccatcagaatggtgtggagtaccactcaattttggaggcttttcatgtataaattacaaacaaccgttcaattggcttttgaagatttcaatcaaccgataggtctcaaaatgaatccgtctaaccgttggattcaaaaagcagagctcattccatgggctgaacttgaaaaagactacgctaaaaattttcgtaaaaaaaaaggaaacgtcgcaaaaccctttcgcatgaccttcggagctctactgattcaaaaggaatatagctatagcgacgaagaaacggtcttacaaattcaagaaaacccgtatttatagttcttcatcggtttgccgggctatcaagatgccaagcctttcgatgctctacaatggtctatttccggaaacgcttggacgaaacaacgttgatagaaatcaatgaaaaaatactcgtcttcgacaagaaaaaagacgataaggacaacgattcttatgacgatttcaattccggaacattgattttggatgccacttgtgctccacaaaacatcaaatatccaaccgatacagaattaatgaatgatacccgtacccatgccgagaaaatcatcgatgttgtttgtgaagggaaaaaactgaaaaagccggttctataatatttggttttgttactcaaactgagtagtgacgccaaatatttttttataacaaaaagacatctggttgtcctataattaaatcggcaaaaacaatcataggaggataaccaaatgtccataactaagaatatcaaatgtacggatgaaaagacaagtcattccatcaaacaaattttgaacatcaaagattcccatattaccttttcaaaagatgccattagtaaagagcgcgttcatggccgtatggccaatgtatttaccggcttattaactggagaagcgcatcgttgcgaatgttgtgggtttgattctgtcatccgtcatgcttatcatgatagttggattcagttgcttccgtatcaagaagtaccaacttatctacacctgtacaaacggttctgttgcaaagttttaaatctactatcaaataaggtagaataatagaaaaagatagcaggaggaatgacgatgaatcattttaaaggaaagcaatttcagcaggatgtgattattgtagccgtgggcaactatcttcgttataaccttagctatcgtgaagttcaagaaatcttatatgatcgtgacattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagcccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaagtcactctcttcgggttttcggtctgtactgaaatcaaggtattattgggaatcccagcttaaatcatagataccgtaagggattttattctttatttaaaactttgcaacagaaccttatttttcccgtaaaggtaagttgctccaaatgagacgacacaacttgctagcatacaaataaagaatattggccagaattcaaacggaatagacaagaaaccaggaattccactgataccaacagaagttgcaatgacgtgttgtgacgccataaatcctccaattattccagaggtcagaatggaaaccacgaatgggaatttatactttagattaaccccgaacattgctggctcagtgatacccatataagcagacaaaccggcagccagtccaacacctttcaactttttattttggattaagaaattcattgcaatagcagcagaaccttgtgccaaacttgacatgactccaataggccaaatataatctccaccgttcgccatcaattgaatatgaactggtaaaaacgcatgatgcatccctgtcacgactaatggcgcaagaccaataccataagcaaatccgccaataaatggaactttttggaataaccatacaatacctgcgacaatcgtattaccaatagcaattgtaatcggcgctataataataaatgttataacactagtaaaaagaattgcaactggtgcaacaaccaacagttggattgtttcaggcacacgctttttcaagaatagctctgttttagctaacacatagccggaaactagagctggcaatacttgtgcttgtagtcccatcttagagatggacaatccaaagattgtccaatgtggaatatctcccgtggttactgcttgcccgtaattccaggcattcatcaaatctgggtgtacaaagactagacctaacacaatcccaagaagaggatttcctttaaagtattttacagttgaccatgttattaacgcaggcagaaattgaaaggaagtgtttgcgataagatttatcatatcagcgacatcagcaatattaggatatacttcaatgagtgactgctcaaaaaagattcctgggtttgttaataaattattcagtcccatcagtaaaccagctgtaacgatcgctggtaaaatcggcacaaatacatcacccaatattttaactgcacgttgaaaccaattcaaattcaactcagccgctacttttttaacgtcttctttgtttgccccactcagcccagattggcttataacctcttcatagatatctgctactttaggaccgataacaacttgaaactgtccattagcattgaaggtacccttcacatcttccaggttttccaatcctgccttatcaactttagtgtcatctcgcaaggcaaacctcagacgtgtcacacagtgagtcagtgctgcaatattctcttttccaccaacaaagttaatgattgatttagcttcttctttattactcattaattcttacctctatttcttctttattagttaatgcttgagatgaatcattgcctaccatgatccaataagcaccatcatctataatttcgttgaactcttcatcataatacttaaaatctttgtttgtaagttcaaaagaaacagtcacactatcccctgacttaacaaaaaccttcttgtaggctaccaagtcttttgttggtcttatataacgaccatattgagctccaatatatagttgaacaacctcataaccatctctacttcctttatttgaaacggtagtagtcaccttccaacagttcttacccttctctttaatgctaattggtgacatagaaaaagtggtataactcaacccatacccaaagggaaattgtggttcattggatacatctaagtatttggtcgtattaaacttttcacttgaatacggtctaccagtattgaaataattataataaatagggatttgtcctaaatgtctcggaattgttattgtaagctttccggctgggtttattttgccacaaaggacgtccaaaatagcattgccagcctctgctcctagatgccaagcctcaactaatcccttacagtacggtagaattttaccaactaccataggtctcccattcatcaacacaacaaccattcgtctattatactgatatactgcttttaaaaagttatcttgaatggcatctaattctatacttgctttagattttgcttcgccagattcaatagctttttcccctaagacaagtacgaccttttcgttttctgaaatagcttttatcgtatcttctgacaatattccatctcgtcggaacgcattgaaggcctcagacatcgcaacataattctcttgctcatttaatgcctcagccacacttacgatatcttcagctttaccattacaagcccatgtatccaacatagcttcctgatcagtgacgagtggacccataaaaagtactttttctgttttttttagtgggagaatatcagcgtcattttttaatagaacgatagattcttgagcgatctttcttgctagtttgcgatgctcattctttcttttttgaacttccttccaccgatcaacactagatctaaagggattatcgaacagtcctagccggtattttaactccaatactcttaagactgcttgatccaaggaatccgccgaaacagtctcagataaaatgagttcctttagataatcatgatacaaccgagaagacatatcgacatcgagctctgacgccatagctaatgtgactgcttgctgttcatctctacaatagccatgtataatagtttcttttaaagcattccaatctgagatcagtaaaccattaaaacccatcttatttctaagaatatcaatcaatagtcgtttgttcaccgttgagggaataccatttaaggcattaaaggcactcatcacactcaataccccttcatctatcaattttttaaaaggtggtaagtatacatttgagagtttatagtctgacatatcgaccgtattgtagtccctaccagcttctgattcagaataaccggcaaaatgctttccacaagcaatcaatctatctttgtcaagcaacccatttgtcatctctccttgaaaacctcttatttttgccgccccaaattctgcggtaagaaatgtatcctccccaaaagattcagctaccctgccccacctcggatctcgactcacatcaatcataggagcaaatgtccagtggatgccagcagccgatgcttctcgagcagcaacttcagcagttcgcgtcatcaagtccttattgaacgaacacgactcagctaagggaatagggaaaatagttgaaaaaccgtgcacaacgtcttcagcaaaaagtaaggggatttttagccgagtttcggtaatggctatcttttgtaaccgattagactgctggatatctttgattgataagaaagacccaacttctccattcattacgagttgctcatagtgttcctctttccctccataaattgacgtcccaacttggttaatctgtccaattttctcttccaaagtcatctttgccagcaaatcatttagtattttatttttattatccttcattgcacatactcctgtttttttgtaatatattactatccgattgattgaatcgctttttacgtccttatagtaacaacttttgttaacgtttactttactgatactaatattaaattgcaaaatagcatacttaccaatctgctagcaacttaggagttgaatcaatgaccttgtccttatcattaaaagatgcctacttttttagtcgtccggtccacaagtatgcgaaacaattgattgaaaaacgatttgtggattgtttcgagattgacatcattactgaaagtaacggggggatgtatattaatgaccactactaccccgttaaaaaaggggatacagtttttcgttatcccggtcaaacgactcaaggagttataccctactcctgttatgccattcgttttcaaactgatgactctctctttatcaaaacagccgaaaaggctgtccccggcgtatcgtcaggagaatctacccgacagatactaccaattattgaatctgtccttaatgaacgaatcgatcataatatgttgtcaaattatttctacgactatcagctgtctaaacttgtttacagtttactaatgctttttcatccaaattctaataaatatgaagacgaccaatcgaactacaacccttatgtgtcagagtgcatttcttttattcaactccattggaaaaatgtgacgatcaatgacctcgtcaatcgcactggcgtgagcaaaccatatttgatgaaactctttaaacaaacgactggaaaaacaattttaaattatattaatgatttgaaactagaacatatcaaaaagatgttgatattcactggtgataatctcaccgaaatcgcattaaactgtggtttcaatagttcaagctattttacaaactacttttcaaaacacaccggattatctccaaaagaatttcgtaatatctatcgaatctagtcgtgatttgactttaaaactctctttaaaataaactcggataacaaagaaccacacttcattttccagaagtgtggtttttgatatacaactattcaattaaaagactattcgactaagcagatattcagatctaatataactactcactcttctcctctgattctttttcttgcatcagctcgaagttcgtaaccttcatgatctttaagtcgtagtaattagaacgcttcccgaattcttcattcaatgtatcatagccaatttcttcggacagggtcggtttgtcagaaaagagattcgttcctaatcccattctttctccttctatgtcgatccccattgcagccaacgtcgttggataaagatccatagtcgtgtaagtcctattagccgttgcaacaggttctgtgtcggagtttaagatgacatctataatagaacgtttgtaatccggagccacgctattgaaataatcacgatccatactcaagtgatccctgacacgacaacaacagtatcttcataaaaaggttgttctttcatccatcttaaaaaatcgcctaactgttgatcggaaaatgatggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtagttcattcaaggaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaataataggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtacaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattaatgaattattaacaacttttgacatcaatcgatcattgagtcataaaggctgtccttttgataatgccgcagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccatcaatttttaaaaccaaatatatatcctgatttcaatcactgacaacacatagattcttcttctctaacgaatctattataaattgagatagttcataatcgctagatattaatttatccactgtcaaatttgctggattagatactagtattataaatgtattttaaagaaaacaagtgtcttcttcacaactattacatctcctccatcctcaaaaatttataccaaaaaataagaaaacaaatgcaatataaaggaggattccccctcccaaaacaataaaaaagtagaaaacgtatttagtcgttttgctaatatcattcgcatttcttatcttaatactaataaaaatataaaaccctatgagtattaaaagtggtagcattttgatcaacaatttttatccttcctttgagaaaatcattttggaacttttttttttatgttaaccgatattataatttaaattttaatgattattcatacacattatatgcgtcaagtaaatcgctataattaaaaactaagagatatactgtaacaactatacgtaaaatagcaatacattttgaaaatggatcaacttcaacgttaaagacacttttaattatgttagataaattaatcgccacagtaactcacatggtttcttgaaaactaaaaatgcggccgcaatcctttagaaatttactatagatctactctgaaaaataaaataaattcactaaattgaattaaaacgtttctaaataacacaatttattacacttaaatctttttataaaggcctacataaagatttacaccatttttctgaaaaaaatactacctgtccaaataatactcatattccacctgtaaacattttaaaaacataagagaaagcctagtattctttactcagcttttatagatacatatatctataccttcaattccttcttccaacattcataagactcaacagttgcactttttttcattctcctacaaattccactaaacaatgcccacttataatcatcaagaatggcagtacctactccccctaatcctaagaaaaacagtaaaagtaaatataaaaataacatcatattcgtccataacgataaaagagtcaacaaaagagaaactaagcctactgtaacaaatgaaaagaacagaataccataataaatcttcaaaagaacagcccattctttgatcctattaagaacagataactcatcctccgtcatcaatcaatccacctgttctttcttctttttagggtcaatactctttaagaacttctcctccaacaccaataaatgacgatatacatcatccattgaccagcctgaagaaaggctaagacaatacaaaaaatcacaaggcaacgtctttactgtgcggtttcttgttacccagcttgctactgtactctgcttatatccatgcaactcacaaaattgctctactgtcatacctaaccgcgaaataataaatacattgatcgggtagggatatacaaaggtattgatactcatagtcagaaagacctcccacggtattattacgtttgcgataataatactactctttcttaagaccagcaagcaaggcggagaaaaaagaagtaacgtatcatagatataatgtaataggcaatttgcacctttttatttcaacctgtatcaatcatgaacagatctgtttgcacgccgatcttattgggttctatcaagcgtttcaatgctgtctggataaacgtgtattctcttccaaaagcttctgagatcgcagcgaaataagctccctggctttctttttttagccggataacagagcgcatcaatccatgtatcgaagctagcataatacctcctttacgaccagcacgaacacgaaaatgaattttgttctcttctctcaactgcttcagcactttgtccagggaacgttttgggatctttaaacgttcagttaactctttttttgtagaaataatgtatggttgttcttcataggattgctcattcaaataggacagtagatcttctgcccattcatgactatgtgaatacttgcgaacagctctttctttcttgaatttccaccaaccccgttttttgttgaatagctgctcttcagaaagattggcatcgacccactcttggcataataggacaattttttctctgtgcgctgcttgatattttccggagtaagcggaacgaatgattctggttaattctcgatcagataaagggttagccaagcggtcattgaattctaacatcgtcaattcacatgcttctacttcgtatcctgacgaaaagtatgccaaagacaaggtgaatatgacattatttcgaccatatacgcccttttcaccttgtattttttgactttttagcaacagctggaaccagggttcatctacttgacgaaattcttgagtagatggtaatacaaaaacgttcttgatctccgcttttttgtccgcatcttctctcattgaccagtcgatccattcttcgaaactataacgatactgtggttcaaagaataaaacattctcttcagaaggcattcttgtgatcccaaaatgattggcatttacatcgacaggaaaccgataatcatttgaaaatttgtttcttagattttttgagatccttttggccacattgatcactttaaaatttgatttcttcgtcacgtatgcaggcttgtctagtacatagaaagcttgaaatccatgcggtgtacgtagaatcattgtcggcataaagccgatctcgtgactggccaagataatttctccatagtcaaagtttggatccaatttgtcaaaatcaacaaagaatgtattgatttgacgcaaattgtcctcagaatgacctttcgtaaacattctggcttcatcagcatacgttccatagcgaaatacatttggtgtccaatgagtgaatcgattattgttttcgatcaccccttcttctgaagtgatcactagtccaatcccctcgatcatgtgttcctttgaacggtacgcaaaaatagccccctttcccgactgatcactaaaagagaccggttttaagtggctgtttttatatttaaatttacgaataccattttgtaataccgtcgaatatacgacatccaaagaagctgccatgactgttattccttcctaaacaaaaagagaacacaaataatctttcgatttgtgttccctcaatggcttagaacgtcagcatctcgttaaatcgcatgacaaaataagcatatatatattgagttgcccgtcaaaaaatggtaaaataaacctataagttcggattaccagtccgaatagatttaattaaatcacataagtggtaaccagccacttacataattctgagacgagcgagaacacatagttgtgtatgtgattcagatgaaagagtgaggccaaattcacttttttatccgtctctttttttttgatttattttcatattaagaatatatgaaaacgccatttaattcaagcgctattttctcaaaaatccattacatactaccttaaatatagttttcctattattatttactactctaattaaagattaacaactacatttgtagagataattattataatatgtactacttaaatcattaattatctactacgattttgtctcatattttatattatatactaccttaaaaattaattatctactaccttataacaataccattgataggtagtaattaatatattgttctttaggtagtaggtaataaaattaaaatacccttatctaacttatattatcctgaaatcatgactacatactaccttaatagaattggttactaccttttttaaaaaatttctaaaattacttactacctttaatgagagtattgtttactaccttattcctttgttatatactacttttattttaaatagatactacctaaaaagtatattatatactaccttattccattttaaaaattattacttactaccatatttagaagttatctactaccgttttatgcttttaattactacctaactaattgaatttcaattgcaacaattcgcttttatttaagtactaccttaatgaactaattttactcgatcataagctttataaactaaccaagtaaaactgacatcccttccaaattaagttttccctcttaagatatatttaatacaactagcgtcttaataacgtgtagtgactaatagagtagtcttgttttattatttattacagtagtatatagatattgtttttaaagtagtaactattttataatatcaaaaacatttatacatagaatttattttgggtagtatgtaatttaatttacatagcattatttatagtagtatgttactattattataaaggtagtagataataaaaggagtgagttagcttgtcaaagaaatttgtgataggaaatttcaaaggtggagtagggaagagtacgtgtgcacagatgttaggtttcgaagcagctgttgcaaaaaatcaaaaaactctgatcgtcgatctggatatgcaagggaatacctctgacgtaatgagcttaacccatatgaacttttctttagaagagggtggtggaggcggtaagcctcttgattatgaaaatacaataaccgatgtattgattggaaaagaacctattgatttaaatcttgaaacctatggggaagttgactggaataaggtagtagataaagatactcgtgtagatccaaaagatgctatatataaggtagtagataatttatatatattacccgcagatatgagctttgaactttatgatgattggatcaaagaccaattctcggattctgccgataaacttatctatatgcagaaacgtttaggaccgctgcttgaagaatttgacattgtatatctagacgttccaccttccatttcaatttatagcaaatctgcaatgtatctagcagattatgcgatcgttgttcttcaaacacaggttaagtccatgcgaaatgccatgcaatacttagaatatatggatttctttgttgaaggatttgatacttcattgaaggttgctggtgtgattccatttatgttagagagtggggacgcagtcgatcaggaaatgtatgcccaagcacaacaaatttatggtgatcatttgctcaaaaatgttgtactaaaaaatgcacgtttaaagcgatatgatggatctggaataacaatggagttaactaaggctgggaaattaaagcaatgggataggcgttgccaccatctatttattaatatctacgaagagctgcttgaacatgaggcttggtatgagtaggaggttctttaaatggctgatataaaagatttaggtatttttagaagcaacaaaggattagataaaattagggcagggaactcagctagaaaaagtagcaagaaacctcaaaccacgtctccatctaatgatataggtaccacaaagtcacaggaagatacaattaataataaagaagtgatccacgaatctccgactccttcttctgaagatactggacaaacggtcattcaaactaagaaaaaaaacagtctatctaagaaagtaaaaggggtaggggctcctataaggaaatttgatcgatctttctctgctcaaatgcctttgaaactttcgcctattttaaacgctacttcaagagtgatggttgaaaaatatgaaacaaatcttactagagacgagatactacgaaaagcactcgatgaatacatcaaacagcacttgacacaagaagacaaacaagacctttttaataatgttatgagggaagtagaaatgtttagggagaagaaacccactatcccagaaacagatgtagatggaaatataattcgtacagtcagtgaaatagaagaagaaactcaaatgattttacgaactaattggggaatgaattataaacattaaaaatctactaccataattagccattatggtagtagatttttagtttattatagataccataaaagtagtacgtaataaaatttcatataaaagtattcattctgataaattttcaggaatcatgggaaagatgacgaagaaattaaggtagtatataacctttatctactaccttaatcattgaactttcttcactatttgttaccattcacattcaccttctctttattatgtaatcatagttacaatctaatttatccaagtctaactaaaagatatatcaaacagtaaaatgattaatattactgtgcagggcaaaaaattaatagttattgagcgatatctattttttgtcaactcatataaaatcgcttcagatttactataaatttaaataatctttcctaatttacaattcagaaataagaaactaatatgatcatctggataggtgattatattagctttttaaaagaatagataaacatctggtgaggaagaggactacttatcagtatgatgaaaagctattagttaacataaatattttaaatacgttatatagcttgataattatctgttaaacgcctttaactttgtataatatatcttatgtaaactaaaataattatgtattcttaaaaataatgaacataattaagattgacctattgtgacacttgcgtgggatcacttactagtaatcaatctagtgcacgaacttttaatatgttaaaattagtagtcgcctatccgacagtcttgcgactggagggaggtgttttcatgattcaattcttcatttgcccccttcttgtcggcttactagtagccctcttcgagtattggctgaataatcgagacaagaagtaaagcaacgaaggcgacatcagcccacaaaatgaaaccccagagaatccgacctctctggggtttcgtggtgttttcatgtccaataattcatttgcatgtatattttaacatgtaatttcaaggaaatcaatgaagacaggtattggaaagagcgctgcctgaaacttcaataacgggcagcgcaactctaaatatacaaatttaagtatatcataataaaaaaatatgaaaaaatttgaaggtagtgaagattctaccgtcgtttgctttacttttattcttaataagttttgtaataattactcgacacggtagttcgttagctacgcagccactgatcgttgcatagtttctgacgttgttcttatgattcagtaactcttattccgtttgcctcctaatagttcatgggcgaagcgcgtccgtctaaaatagttgcttctatcgtttgaacctcattgacaatttttggagaatcttaccatcccttttcagcagttaaatgtaaaattctttaatagctacgcttatttttcatccagaatgataacctcccaaatttttccttctatctatatagcatcattttgtgtttcacgtaattgagctagttgagcaaaatcaattaaagattcaatcgacaatccagcatttcgcaagttttttgctagataaatccaatttaaatcattggtagtataatctcggtagccgctctcgtggcggtgaacgggtggtatcacgccaacacgctcataatagcttagtgtatccacacttaaatcaaacatttcagctgcttttttatattcatcgaatctcctcctcattcttcttatttataataaaccatggagttaactctagagaaaccagaagcctcttgtctctatgataatactacactaaatacctcctcacattccgtagactattaaaatattaagcaatagataaaatcagttaaatgcaacttctcatattctaatgtttattaagtaagaataatgttaaaataaaaaaacgaagagtattcggcgcagtccagaaaaacttccccaagttttctgtgccggtactcttcttagattaatgcatgttgcttaatcagcctacgctatatatttcttttttgcaagtaattacgatgtagaagcaatgcttaggaatcctttacgttttttctatttttacttttgacttcttttaagtgctatactggataagtaccatgaaagtaggtgttcaaatatgaatactaatttttatccagtggaagtttttagttcggactaccgtttatattcatcaaaagcaaaaacaagtttgtatgattttcaatcgagaccacctttgatcacgtcatttgctgtgctaaatttgaaagagttgcgcaatattcaactcaaattatttatttacgatattgatatcgaaaaattttctactttagaggaagctaaatctagatgtaactctcttatgtataaataatttaactagctgatcatagctagtttttttgtatatctgtatctaatgaactaaatgttcatccttaatctgcttaataaaaagaaatatttatcgctaaacttatggtggcggatttagaagtttatagattagcgaatgacacagaaatatctgccatctgctatgggtgaatcagataaaatatatttctggatggttcctttgaagagtttttctccttcacagcaactttttaaagaagtatacattttttcagaaccatccagataataaacattgattccctgaatctgattataattaatcggagaacgtcgtgtacaagaaagttgatctcctagatatttcacttgattaacaatcattgggtcattaagccaatttttgttaagtgtcaattttacgattaactgatgaatagcttctttttgcattttattcctccactcaaaccaatcgtctatccagttttacatatacatagtacgtgatcaaaaaactcaatctattcttcattgatctcagttactcattaaatttttataatttataactgttctttccgtagtattcgtcacttctgaatttgaaagggttacaactgccgaattgctgagtagctttataattgttccagctgtttgtttttttctatatctaaatatgacctgttgatctatatgaaaagattggccttctattgaaagttgttgtggtttccattgtgaaaaactcattcttacccctcctttgaagtatgaaaaaaccgcctcacacatgttgagacgggttaaaaggaacttttatgctttatagatattagcagcttgcaaaccgcgttgaccttcttcagtatcaaaagtaactgcttgaccttcatctaaagatttaaatccatccgcttgaatcgctgaaaaatgagcaaagacatcttgaccatcttctcctgtaatgaacccaaaacctttatctgaattaaaccattttactgtacctttattcatactgtttcctccttgtgcatctcttcgtatgcgttttgttgcaataaatgtttgattggcaaaaggagagtataaatttaagcatagcactcttaatacgtttcaaaatatatcactacaagtagtataccacataattatataggaatgtagttttttggaaataaggtatttttttaaaataaaacttaatgatacgaattttatgcctcaatcgcctagtaatattcatatatttcagctgcttgatataatatgtcattattttccattgttttttccttacaaaaaaagagatttctttacgaaatctctaaaagttaaattatgagtgttttaattgctggtttgaggtgtacacacacaaccctattaaagctcaaaccaccagtacattccaacgcaccgaagactatcacagctatagtagatacttaagttacctacactattgtattctcatatttgtactattttgtcaaacatttctcgtgaatctacactaattattagctttaaaaaggaatagctatttcactcagacgaatcatcggtcgaccagttccttgaaggctgaatcatgttcagttagagcttgattagcgaacatctcaatttcataaactaaattactatcctcttttatatcgactttgagtttttttccttcacgataatatgcttttgcgaattccatatctttttctttatttcactcaagtctttaatcagcacaagtggcccatcatctatacgttcttttgtgttttccatgataaattaaaggattcctcaattaatttacttgatactttatatatcttattattccgcctaaaaatcattcattgactgttttactttttctagagttattattgcccgctacttttcaaattctttgctaataattaataccaaagatacagtattcatacataaacgataacatctccaattcatcaataacttgactactattatagtacctggataaaagcttattaaacttttcgaaaacagattcaggtatcgacagtaatccaataccgtttctaaacatgatcttattagcagttaacagtgcagttctcttattaccgtccccaaataattgatttttcgaaatgaatagaaacagtcgcaatgctttttctgtctctgacatatcttgattcattatctcgtcatattggttctttacctcgtcttcagttaactttggtggaacgtatcttccttgaatagtcgatccttctcccccaccggttcgtatttcaccgggaaaaagcgcatcctcagctgcaacgatccgattaatccgcttacttgtctctagcaagggctcctgtacgtcgtttaaaagcatttcaaagcctctttttaaggtaacgacgctcaggacatcatctacagccacattattggcccgattatacttaataatctcttctgtttgtaatagtgttgtattcaatcctgcaaattttcccgcattatacaccagttccacaatgtttttcttcaataaatacacagactctttgcgagataagtggtatttatcaggaaatttcggacgcttttcttcgttcattttctcacctattgagtttttccttctattatatagggcattattctgtcatagatccaagctctttactgcggtatccttatcttcctgggtgatcccaatatagcgtaaggtctcccgttgcgaagaatggttgagcagcgactgaatgatctctgttttggtcccttgtttgtacaaaaaatagccgaaggtcttgcgcatcgaatggggaccaatttctttcaaaccaaccgccgttcctgcttcatgaatgatccgccaaaggctttgtcgagtcaaaggcgtatctgctccttttcgacttggaaacaaatacttgctgaagtcttgtgctcgcagctgctcaggaaattctgactgaacataatcgagaatcacttttcgtaatttattcgaaatgaagactgaattgtgtttggccgttttttgttccttcatggccagacgttctttgacgatcacacgtccacgggaaatttctaacacatcacttaattttaactgtcttaaatcggagattcgatacgctgtattgattccgatcgaaaaaagcaccaaattccgttgcccatatttgccggaagccaaaatggccttcatggcatcgatcttttttttgtcacgaatcggttccacgctcttcatttttagacccctctcaaatgttacttaatatgattataacagataataagtcacatttaaacaagctatagaaaaaagacgctaaaagaaaagtgattttctcttagagcctctaaggatggagcgattttaacgaatgtgacacaatacgattgtgtcacattggtcttttgagattttcggtaagatttgattatctcagaacattaatattgcccctttaaaaaattttgtcagtacttttaagttattctattctgaaaattcaaaattttcagtctatataattaacttatattcagttttaccaaatgataagctttaaaaagtattcagaatttagtcatgttataaatccaataaagtagatatggaatatttattttctcttgtctaatttataagaactaaatgatttcatcattgttttgacacttttagttgggagcgtcaataattttgtgtaaatggttcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaagaattcaatcaagttcgtagagtaaatagtcttgcgtatggctaatgagaaaccatagaannttccagaggcattggctggcgtctctactacataccaaccaggaatctctttggcttcactggcatatggtaacccgacttttccattcaaaatcgttgggtcgcttaattcgttgccgtctgtatcttcatatcggaccgtaactggtgccgcatctgagcgatcatagacatacaccacttcctgcgcttcctcgctgaaaattccagaagcattatctggtatctctactacataccagcctgggatctctttggcttcactggcatatggtaacccgacttttccacttaagacagttggctctgctaattgatttccttcactatcttggtatttcacagtcactggtgccgcatcactgcgttcgtatacatacaccacttcctgcgcttcttcactgaaaattccagaagcattatctggtatctctactacataccagcctgggatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcactgaaaattccataggcattatctggcgtctctactacataccaaccaggaatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcaccgaaaattccataggcattatctggcgtctccactacataccaacctgggatttctttggcttcactgatataaggtagtccgacttttccgcttagaatcgttggctctgttaattgattcccttcannnnnnnnnnnnnnnnnnnnnnnnnnnnnnnnnnnnnnnnnnnnnnnnnnnnnnnnnnnnnnnnnnnaagagtatttattctacgaacttgattgaatcctttaataagcaaatcaagaaatacagccaccgccaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctcccagtagttcattctatataggtaaaataaatattaagtattgtgaaacaaatattaagatgttgattaattcggatacacggtatatactttttttatggagctgataatatgaatattaaaaaaaggaagattagagaagttggtaactcagtagttgttactctgtcaaaagagagtttattacaaaaaggattgaaacctggggatatcatttttattgatgaagataaaatgatggatgctattgtcaaagaagaaagtaatttagaccttgaaattgatatgtacgtgaaccaggctctttctgagtatgatgcagcatttaaggaattagttgatagatgatttatttaagtgaaaaagatatagtaaaattaaatgttattcaaataaagaagtattcaccacaggaaacaattggcgttattgacaaaaatgctttgagtatggctgtaaatcagcctaagcagcatatttttggagaagcactatatcctaatgaatttagcaaagcagcagttttattaataaatctgatcaaaaaacatccattccataatgcaaacaaacgtactgcatttctagcagcatatgtttttctcaagctaaacggctactcactaaaaatggaaaatcaggaagtcgtagaatttgtagttagaattgccacttatcagggtgaatttgatgagctaaaagaggcaacgacagatatattaaaaaataattcaacgaagattgatacaaaaaaatagaagcaaactaaggctttagttaaaacgagatcgttagtttgctttctattttagtttacataagatatagttttaactccttttgagagttgcttcagtgtcgccgtttactataactgctgcaatttctccatcttccacaactggttgtcttcgaatcaacacgtaactatcagaagggattgtaggaaccatgctattacctttggtttttaaataaaagacttcaccagtgggcaagttttcgtctatctcttctctatattcttcaatatattcttcaatatattcttcagctaaaatagtatctccacaagcaatttctcccaaaacaggaatctatctatattttttaacaggtattaaatttttaggtatctcgccataccgcggatcaatcgtagacttcaatatgccaaaataatctgctatgtcgttaaaggcagcgcgcgctaatgctggattcactagcaaagaagccgctaaaactgctgatgtgcattttcaaacgttgtccaaatatgaaaaagatagttctgatattccattttctcttttaaatgagctgtctaatctgtatcaagttcctattaacaatatttttttgggcaaagagtacgatttaatccgtatcataaataataaaagaaatgaggtaatgaattgaacgaagtttcaaaggacgttctggcaatcgaagcccacgaaaaagcaaagtcttagtctgatacgcttaacacttctttactatagattgctctaagtgtaaaccgtcaggcttttttactgtctatatttaactagcaccacgcgtatgagtattagtctcttaaattaaaattggtctggaaagtaacttgtcaattcaaggtctttatcaagggctattaaatagggaaccttgtagggaaatcaattcattttatgaaattgatttctcttttgtttaaacaaaattatcctaattatttctaattgattctgtaagcactttacttagcgatacataaaaattgtgatacaattcagttgtagttttaaaggatattatggtcactaagttaaacatataaatttttatggaggtgtgttaatatggcaaatttctacggaaatgatcctttttttaacaatgatatggatgatgttttcaatcaattatttcggcgcatggataatcaaaattcggagcgtgcacggtatttagttaatggacaatcgttgacaccagatgagtttgctcaataccgagcaactggtaagctaccccaaaataataaaacaatagaagtatctaaagatggtaaacaggctgttaaaaaaggagggattttagaaaagttagggactaatttgacggaacaggctcgtgatggcttactagatccagtgattggacgtgagaatgagattcaagaaactgcagaaattttgagtcgtagaacgaaaaataatgcaatcttagttggtgatgccggtgtaggtaaaactgcagtcgtcgaaggtctggcacaagcaattgtggctggtaaagttccagaaacgattcaagataaagaaatctattcgattgatttatcgtctttggaagcgggaactcaatatcgcggttcttttgaagaaaatattaaacagctggtagaggaagttaaagcagctggtaatattattctattctttgatgaaattcatcagattctcggcacaggtgccactggtggtgaagatggtggcaaaggattggctgatatcattaaacctgctttgtcacgtggcgagctgagtgtaatcggggctacgactcaagatgaatatcgcaatactattttgaaaaatgcggctttggcacggcgattcaatgatgttgtgataaatgaaccgacggccgctgacactttacgtatattacaaggtgttaaagagctgtacgaaaaacatcatcatgttgtattaccagatgatgttttgaaggcggctgtggattattcaatccaatatataccacaacgcactttgccagataaagctatcgatttgatcgacatgactgcggctcatttagcggctaaaaattcgcaaactgatgttgagacattggatcaacgacttaaaaaattagaggcagctaaggaggccgccattaaagcggaggactttacaaaagccgctgatatcaagaaatcgatcgaggaaaccaagcaaaaaattaaagaaacggatcaaaaagaaaaaatcattgccacgattgatgatgtggcacaatcggttgaacgtttaactggtataccagtttctgatatgggcgctaatgatattgagcgcttgaaaaatcttgataagcgtctgaaaagtaaggtaatcggtcaagatgaagcggttgaaatggtagcaaaagcaattcggcgtaaccgtgcgggcttttcagagggtaatcagccgattggaagttttctgtttgtgggcccaactggcgtaggaaagactgaattagctaagcaattagccttagatatgtttggaaatgaaaatgcgattattcggctagatatgagtgaatattctgatcgtacagctgtgtcgaaattaattggtacctcggctggatacgtaggctatgaagataatgctaatactctaactgaacgggttcggcgtaatccatattccattgtattattagatgaaattgaaaaggctgatccacaagtattaactttactgttacaagtgatggatgatgggcgcttaacggatggacaaggcaatgtcattaatttcaaaaatacgattattattgctacttctaatgctggctatggtaatgaagcattaagtggtgacaagcaacgagatcagtcattaatggataagttagcaccatttttccgcccagaatttctgaaccgttttaatggaatcgtggaattttcacatctgactaagcaagacttaagtcaaattgtcgagttgatgttggcggatgtacaaaaaactttagccaaaaaatccatcaaacttgaggtaactaaagcggccaaagattggctgatggaacaaggctatgatgaagcaatgggtgcgcggccattacggcgagtaattgaacaacaaattcgtgataaggtaacggatttttaccttgaccacttagatgtcaaaaacttgaaggctgatttagtggatgatgagattgtgatatcggcagcttagcttaaatcagtgttcataaataactttatataagaggagatttattgggaaggagattgcttgatagatctcctttttggttctgttgcaaagtttttcgatcaagaccttttagtgtaaaatctaactaaaatgacccgggaggaacgaagatatgaacccttttaaaggaaaacaattccaagaagacgtgattattgtggctgtcggttattatcttcgcggttctgttgcaaagttttaaatctactatcagataaggtagaataatagaaaaagatagcaggaggaatgacgatgagtcattttaaaggaaagcaatttcagcaggatgtgattattgtagccgtgggctactatcttcgttataaccttagctatcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnaagatgatagtgtaaaagaagaaaatgaagttataagagaagaaaaagaaattgaacaaagaggtaaatacgatttagaagtagtacacgcagaagatattgatccgaaaaatattattcaattagacagtgtagaagaattagaaaaaattctagcagagtttaaaaatagcagtgaaacagaatttacaattaatgagaaccctatacaaaccagagctgctggaagtaaaacagtctctcaatgggctccgtttagtggctatggaatgactggacttcctacttggagaaatgtatccttcaattatgaatacaaaaaagtaaatggtaaaaatcaatttactaaggtttcaggaattaaatcttactattcaggcttacaaattgctgttacttggaatcaaaccagtgcatcttcaaattttgtaaaaacaaataacactaaagacacagtaaaaataaaagtaaacggatatacaatattagaatttcaaaaaaaaggatttaagaatggagaaaaaaaaaatannnnnnnnnnnnnnnnnnnnnnnnnnnnnnnnnnttaaatgaaaaaaatgaagttaaaagtgaagaaaaataacttgaacaaagaggtaaatacgatttcgaagtagtacacgaagaagatattgatccgaaaaatattattcaattagacagtgtagaagaattagaaaaaattctagcagagtttaaaaatagcagtgaaacagaatttacaattaatgagaaccctatacaaaccagagctgctggaagtaaaacagtctctcaatgggctccgtttagtggctatggaatgactggacttcctacttggagaaatgtatccttcaattatgaatacaaaaaagtaaatggtaaaaatcaatttactaaggtttcaggaattaaatcttactattcaggcttacaaattgctgttacttggaatcaaaccagtgcatcttcaaattttgtaaaaacaaataacactaaagacacagtaaaaataaaagtaaacggatatacaatattagaatttcaaaaaaaaggatttaagaatggcgaaaaaaaaaannnnnnnnnnnnnnnnnnncctatatagaatgaactactgggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccttttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcgacggttttccgctttaacggaatatacgttgcgtccatataaatagcagcataacggtcatgaagctcccgccctttaaacgccgttacctcttctgtaaatgattttgttatattggacatggtttggggcgtgtagtaatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctctccaatttaccttcaattggtaagagttttacgtacttctttaaatcataatctttatttagcaaattgtttgtttcatcaatataattcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagctttagcattagaaaataaatacagaaaataaaaaagccccttctcatttgcagagtgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggttgtaataatagatatattggtcaatttttgttttcaattcatctaaactccgatagacttctccgtgaaaaatctcttgctttaataaaccaaagaagttttccataggtgagttatctaaacaattccctttacgagacatactctggaagattttatgctgcttcaatttattcttataagcattcatttgataggcccatccttgatctgaatggaaggttctacgaaatggacaatcatttgtcatctggattgcttcttctaatccttccattatggctagtgcgtttggtttttcagaaatccgataagatagaatttcactattgtagaaatccatgaaaggatctaaatacagctttttctgacgaacgacacctgtggtgtctacttcataatacttaaactctgtggtatcagttgtaattttttggtgacagatatttgtataaaaccgacgatgaatacgatttttggcgacagtgccaaccttcccacgataagaattgtaccgtcgagattttcgagtgtaagactttacttcgatacctagtttttttatcagacgttgaatcttctttttattgacatgaatcccttgattctctaattctttttttagtcgcagacagccgtaatctttatgatctttgcgaatttcaagcattttttcttcaatttcttggtctgggtttggtctgtcaaaccgtttctgccaatacatataggttgctttaggaaatttcaatgtttcaagaagctcaactagtttgaatgatcctcggaggctggcgatgattcgtgcgattgattcttgcgtctttgctgggcttcctgttttcgcagcttcctcaactcttttaaaaaggcattctcaatttgaagggatcggacttgcttttctaatgccttgatacgatcgcgttcttcagttgttgtattttcttttttgttttctttttttctagtcaaagtaagtggtcgccctttctcttttgagagcccctcaatacctgcttctctgaaattacgcatccaattggcaataagcgcagggttgttcatttctaaagtgctagcaacttctcgataggacatctcacttgtttgatataactctagcgtatttaacttaaattgaacagaatatttctgattttgatgctttctcaatagaccttcctctccgtattcacgatagacattcacccaattacttacttgagacttgcttgaaataccgtatttgttggcaagataccgatatccgcccacgccactaagatattctttaacgatttttagttttaattcaaaaggatattttgccatacaaataacgacccccaaaagttagattttttggtctaacttttgggggtcgcttcacctagcaaatgatcgtggtctttaaaaaacaggtaaacctattgtgaacgtgaaaaacgtctgctttgcgcgcttattctttgtagctttgaataatataataccctttgtcttttttgatgatttcggcattacaaaagttttgttgnnnnnnnnnnnnnnnnnnnnnnnnncgctgtgttctattcatcgtctgctctgtgcggcttgtgccgcccggtcgtagtgattccgctcgggtgactacgctcctggttagtcgcctagtactattcatcatctgctctgtacggcttgtgccgcccagtcgcagtgattccgctcgggtgactacgctcctggttagtcgcctagtactattcatcatctgctctgtacggcttgtgccgcccagtcgcagtgattcatagcaaaaaagtgagattcgggttgaacctcacttttctttgtttgattaacgacgtaatcctaaagcttggatcaattcgcggtaacgttgtacgtctttttgacgtaggtatgctaataagttacgacggtgaccaacttttttcattaggccacggtatgaatggtggtcttttttgtgcatacgtgcatgttcgttcaaatggttgatttcttctgtaagaacagcgatttgaacttctggagaaccagtatctccttcatgacgagcaaatttgttgatgatttcgtttttgcgttctttcgtaattgccatgtttttcacctcttttttcttttttcacctgcgactgagtaaaacgttggtgactcgttgaaccaagtaacaggtagcgtgtattcacacgtaattactttactttattctacctaaaaatgcaagtttcttcgctgaatcttttcattttaaaatgaaagcaacactccaacttatggtatactaaatctagaaatttcttaaagcaggtgaccttatgagcgtcctttctcgcattgaaagtatccagagcgaattatccaattccgaaaaaaaactttttgattacatcaaaaaaaattctgaaaaagttccttcgatgactgcgagtcagttggctcaagctaccgggatcagcgcccctacagttgttcgttttgcaaagaaaacaggcttttccagcctaactgatcttaagattcagctttctgcggaatctggctcccgacaaacccatgaggagatcattggctatgcagatgttgcattgaacgaatcttttcatgatattactgcgaaattgagccataatgcccaagtgactatgcatgagactgcggaccttttagaagaacaagtaatgctggcagcagcggacctactgaaaacccgcaatcggatcttcgtatgcggtatcggtgcttcctctttgattgctcaagatatccaacaaaaatggactcgcttaggcaaagtggttattttcgaaaccgactataattcgctgttgcctcaattgatcaaacacgaaaaagaatgtttgctctgggctgtctcaaacagtggtcaaacacctgaaatcctacaccttgcggagtttacgaaggagatggggattccagttctatctttgactcgctttggcagtaattccctttcgaaattagcagatgttccgctgcaagtttccagaccgaaagaagccaatatgcgcagtgcagcaaccaactcgattattgctcatcttttggcagttgatgtgctgttctatgtctttttgagtaaaaatgaacagctggctcaaaatatctacgaatcaagacaggccattgctgactatcgtcacaaatatctctgatcgtcaaatgcgcctgctaaattcagtggtcgaaacttaaacataaaataaaatcagttgaaacactcaaagcatgctccagaggtccaatcgtccctctgaagcatgctttatttgctggctaatcaggtccattccctgaatcgatcccattgtcctttgctacttgcgccatccaaaagctcgacgcttttggtgttcgggtatcatctgtcaaatctactcgataatacccataacgatttttatacgcattcagccagctccaacaatcgataaatgtccacatatgataaccgaagcaaggggctcctgcttcgatcgcccgctgcagttctttgagatgatctgttacaaattcgatgcgataggtgtcattaatctccccctcttgcgttgcgaagcgttcttcttgagaaacccccataccattttcagaaatataccaaggaatcgtgccatagctattctttagacgcatggcaatgtcataaataccttgcggaaagatttcccaaccgcgatgagggttgatttttttgtccggccaatcatagcctcgaaaaagatccctcggccctgtgattggatcgttcggcgcaatcggggcttgaactcgtaatggctggtagtaattgcaaccaataaagtccaccgtatttaaggcaaaaagttctcggtccccctcctctgttacaggagcaagacctgactttttcagcatcgcgactaatttttctggaaatcgtccgaggactgtacagtctaaaaaactgcgaatatagagtaagtctgcccattcagcagcttcaagatcagcagactgcggacttttcggatagacgggcgataaatttaagataatcgctatctctccgttaggaatcgcaagttcgcgaaaagcagctactgcttttgcgtgagctaacagtgtatgatagcctacttggatcgctcgtttaaaattatgaactttaggccaatgggcatcccccatatatccgcattcaatatgaactaaaggttcgttgaatgtggcccattttttgacaatgtcgccaaattgctcaaaggcgatacgagcgtaagcggcaaagtaatctaccgattctctggcttcccaaccacctctttccattaaccaccacggcatatcaaaatggaacaaattgatgataggttcgattccttgatcgaccatttcttgaaaataggcacgatagaaggtgactgcttgagggttgaccgtctttccatcaggtactagtcgtgtccaagcaattgacgtccgataagagttcagattcatggctttcatcagcgccacatcttctcgaaagtgtcggtaggtattcgaagtatcactaggtcctacgtgatcgtagaacttgtctggctccaattcgaaccatttatcccaagttgaagggcttttgccatcaatcgccgcagcgccttccgtttgaggagcagaagcagctgctccccataaaaatccttccgggaattttaacatgatttctctccttttccattttcttcttgtttcaatggcttcgtgaatacttgtttctgattggctgcttcgacttggatgataaaatcagctggcaattcatttggtgaaatgttcaaccgtttcaacgtttcataagaaactgttagagaaaagtcgacggtgcttttggctggcaaaaagactttttgaaaaccgcataacactttgacacgcggtaagacctgctgtgagtaattgcgaaggtacacttgtaccacttcagctcctgctatcaccgaaagattctcgattgttccattaatttggattgcttgcggagcatactgcgcatggattcccttaagcataaattctgcatagcttagaccataaccaaacccataacgaggggttcctgaacaatctgtgtaatctctctggaaagcagcctcacggtagttgtaataaactggcagctgcccattttcatctggaatagaaacagctagtttcccactgggattcgtttcgccaaaaagaatccgagctagcgcacttccgccaaattgccctggataacctgcaaaaagcaacgcatcaaaagcggtactgacctcacttaacagatgaggacggccagcaatgacaataccgatcagaggtttctgaaattttttcaattcagtaatcaatcgtttttgacattctggcaatgccaaagacgccagatcgatattttccccactggtcatctccgcagatccttgcaaggcagctccattcttatcaaaatccgtcgaaaagtcacgaatactagagccgccaatcgttaaaatgatttgatccgctgttgctgccgcttggcatgcggcagtcagttgctctttggttccttctgtgatgccgcagccatctgcttgaataaaagtggtttcggtccccttgatttccagcaacccctcccacagattgcggcactcagacagttctttgaaaggagtatagtcccctagctgatgatagctgtttttgctatgaggaccaataacagcaattgtttgtctttgtttctttaacggtaagacttgctcatttttcaacaaaacgatggcttcttctgctaaacgagttgcactttcttgaaactgcttttgatccggaacggacaccgtaggcaccggttcgtcaaaaagtcctagctgctctttcagtttcagaacgcgcatcacggatcgatcaatggtttcttgcttaatcaacccttgatcaacagcagcttccaactgagggaaaacattgtcccataaactgatgtctacgccgctgttcatggcccgggctgccgcttctggtttgtttcctagccaatccgctaaacggtccaacgcacaaccatctgccatcacaactcctgcaaagccggcttcctctcgcaaaatctcttgaagtaagcgagggttcgcgtgacaagggacaccatcccaatcattataagcagccatgcaccctagtgcccctgcctgaattcccgccagcatagcgggtaaatgaatctctcgcaattcttgctccccaatattgactggtcctgcattgtgcccgcccatacttgaaccttgagctgcaaaatgttttaacacggccagtacatgggttgtcggttcatgaccaagtatttccccttgcattcccttgaccgcagcttgcgtaaaacaactggctaagtagggatcttcactgaaacattcctcggttcgtccccacctaggatctcgtacgatatccaaggtagagatcagcccaacttgcgcccctttagctcgtaactcttgtgccacgaacgtctgcacgctctgataaagatcaggattccaactagcccctgtactgaaattgaccggcagtgttgttgctgctaatccttgatgaccatgaggacattcttctgtcaaaaaagctgggattccaagacgagtatgttcttttaaatagtcctgaatcatccggctgacttcccgtgattcttccaccgagagacccgttgttgcgtccttgcccgaccaaggatctgctcggaaaacgccgtagatccagccaatcgagccaaagcgagcaacttccgacttgaagtagtctgtcaaataaagttttccttcctttttctgataaacttgccagccatacaatcgctgattcaactggccgattttttcttttagggacatcttctttacaatttcttcgatcattttaaactcctatcatcaaaaatgccgattagtcaaaatagaccttgaccgtttgaatttcataagggttgaaaggaatcaccacttggtggcacacgcccgtgaccactaactcctgctgttcctcttccaataaattcgttagcactgctcgtttgatttttttagctgcggtcaagcggcatgtcgttttgcgattgtggtattcatacaaacgtaccacgatggcttcatctgcttcagcctttttgaccgaatcgatcagcacattattgtgatccacttgtaaaaaagattgctcttgctgctgatcaaaatctgccaatacatatgctggtacattgagtgccaacgcttcttccatcgtttgtccttttttccagtcaccttcatgaacatagagagaataggtaaacgaatgaagtccttgatctgcttctggatagggatcagtcgccgacttgataagagagagaccaattttttggtaagctgtgctgaatccgtatttacaatccgtcaacacactgacgccataaccatcttcagacaagtcgacccatttttgcccacaactctcaaaacgtgccaaatcccaagtggtatttttgtggatggcacgtttgacattcccaaattggatatcgaaagtggcatctagcgtattgacggcaattggcaactgcgccttcaataaaagatgatgctgatgccaatcgaccgttgtctcaaagtcgatcctgccggttccatgatagaaatggatcagctgaatgatcgttgattgctcaaacgtccgtttgatacggatcgtgtcacgaatctcgccttgctcgacgattgatgcgtcagtcacatcctctactggataagctttacgatcgtagtagatgtctatatcccacgcatcataatccatcggtaagtcttcataagcaatcaattgattcatcacttctcctgctggcaagacctctcgctggtgtcttttgtcaaaaagagcagtcatttcatatgccgcgttaaatgttacgacaaagtcggtcgtttccagttgacgagtcaacggaacacactcttgttctactggttctgagatagtctccctcaacgttaggggacgcagacctaagctagggacttgtggaactttgaccagcaaacaaccatcttcggttcgctgtgtcagataatcttcttgaatcgccggactatcaactttgattacggcatcacgagtaaagcctaatggattatagaccacctgatgatttgcatcactggcggttcctcctgccacgagggactggatcaattgctcgccttcttcaaaaagagcagcatactcttcttctgtctgctggtacacttcgccaatcgaacttcctggcaaaatatcgtgaaattgattgaacaacaatcttttccagagcctttcgaggagctcttgcggatacgcttcgcttcgataggcactgtaaagcttctcaatagtttgcaataaaaattcgcctttgcggttggctttcttatttttaccgatggaggtcagtgtcccacgatggtactcaaaatagagttcgccaaaccagaccggggcttctgaatgagcaaaagctgcggctaatcggtcaaaaaatttgcccgcatgatcgccagtgatcactggcatctgagggagtggttttgataaccgctgttttgtctccagcatctctctagtaggtccgccgccgccgtctccatagccgtatgcaatcaagatctcatcatgctgatctttttgttggtaccgttcaaagctgcctttgactgtataagggtctaaaagcccattgtaagtggtgtagtagggtcttggactgtagccttcactgatcgttgtaataaagtgagtcaaaactctgctgccatcgatcccttgccagtaaaacgaatcataaggaatctgattgaattgattccaagacaatttagttgtcatgaaataaggtgtattggtcttttgcaagatctgtggcaatgcagcggaatagccaaaaacatccggcagccacaaaatctgactctcatgatcaaactcttctttgataaagcgtttgccgtataaaatctgccttaccaatgattcaccggaggtcaagttgcaatctgcttctacccacatagcaccttctacttcccagcgtccagatttaatcttctctttgattgcctgatataactcaggatattgttctttgatcgcttgatataactggggttggctttggagaaacgtatattcagggtattcatccatcaattttaatacggtctgaaaactgcgttctcctttttcaaccgcttgctgtgccgtccaaagccatgccagatcgatgtgggtatgcccgactgcggtcactttttgacgaatctcttggctgtaacacgcttgcagacattcttgcgcgtttgtgaggccttcatagaatcgcggcgtatagggggctcgaaaatctaatgcattggcagcttgtgacagacagctttgatagatttgttcttctccgccaaatttcctaatggcacgccaactgtcaaaaatcgtcgagaaatcaaaccagacttgctcaacgataggatcgatcgccaatagattcacgtaaagcggaaacttcttctcttctcgtcccgaaaaaatatcgatctgtaaggctattgttcctgttagctccgtgggatccaaccgcacttctcgatggttgacatcaattgcctgaatgtaattcccattcaagaacactttcatttgcggatttgtcgtattgtcccattcagagagcgaagaatagacttgcaaagcaaccgacatctctttccagtcttccggtagttcaaaagttcctttcattgtgtaataacaattcttttctccaaaaaaagttccttgcacatagggtgcccagttttcttgctttaactgcaagtcattaacaggcacctgatagcgaatccggtaattctttaattgaaataaaatcttacggatacgttcaaattcaaataactgcacgctgtattctctcctttactcggtttctgaggaggaaaaaagcgggtagacaagaaattgtccaagcccgcttctcctattgccttgactctagttctctttccaacgatcatatgctgtttggtaaacggaaatgtagtcatcgatccccatggactcgatcgtcgaaacatatttatcccaattactgattggctcgacacccgtaatgaatttggcttccatttgttcgacatacgttgtcaagtcagtagccgtagcagccactttatcattttcttctacagtcagataaagtaatggaaatggcacttccgcaatgtcatccatcttatctgctgtttctttggccacccagtcactgaaacgagtatcaggttgttcatccgcggatttcaagatttgatattcacctgtcgtatcgataacaatgttcggtgttgtcaacccgtatgctggtgtgatcttgccacgttcatcttctgtattttctgtatcaatgccttctgcataaactcgtactttttggccgtcagcgttttctttgtactcccaaagaacgccttcaggtccttgttcgatatatttcgtaccttcttcagaatagaagtaatccacccagcgcatcgaagcttccggcgatggattgacatttgtgatggcaaaggtgccccgagaaattcgtggacttcctggaatcactgcttctggcgaccattttgaagtcaatggttggaacatggcatcgttcatcgcttcaatctcgctgcggcctgtcgtaaagaagctgaagtaatcggcgaacaagcccaactgatcattttgtccttttgcttttttctgttcgtcggattggccataaacttccgcatccaacaaaccttcactatacaatttgttcatatactcaaggaatgctttatagttttccgagattggtgtataagaaaccacatcatcatctacttgaacgcctcgtgtccgtaacccaaaagctgccatcagccatacccttgttgaattcatatcgacatcggtcaaaggaatctcatcggctttgccattaccattgggatcttcgttcttgaatcgtgtcagcaaatcatacaattcatccgttgtctttggcagttccttgacattcaacttatctagccacgttccgttgtaccacatcggaccttgccaccaaatagatgtcgcatttctcgaaatcatcggcaatgaataaatatggccatctggtgtggtgatcgattttaagatggacgggtcttcttgggtcaatgcataaagattaggcataatttccggcgtgatatattcttctaacggcagcagaattccttgggaaccataatcgatctccattgaagaagtgagcgaattcgatcctgcgccataaacgatatccggcagatcccctgaagcaaatgctaagttcaacttggtactaaagtcagcagaagggggtgtcgtataagtcagtttgattcctgttttttcttgataatcctgcagcgtcggcatatcttcccattctgccatacctactcctggcgccataatgttcagcgtcagttcttcgccttctttaatgatcggaaattggctgtcatgattgatggctaccccttcattttctccggttgtttccttttttgtgttcccgcacccactgagtaaaagtgcactgcacaaaaacacccctgttactcctaaaatttttttcattcccatcttcttcctcctctatgttttatcctttaattgatcctaccatcatgcctttgacaaaatatttctgcaaaaatggatagacaataatgaccggtaatgatgaaacgatcatgacaccgtatttgatgacctctgctaactgttgcttgctgtataacatactggccatttcggaagtcacattgctgacagtatttgatgacatatcttgtaaaatcaaaatttcccgtaaaatcatttgtaatggatacatggatttatctgacagatagatcaatgcgctgaagaaactgttccagtgccctaccccgtaaaaaagtgccatgactgcaatgattggcgtagataaaggcagtacgatctgcatgaataaacgaaaatccgagcagccatccacgattgccgcttcttccatctctcttgggatcgtcgtttgaaaaaaggtccgcgtaacgaccacattatagacagagacagctcctgggataaccaaagcccaaaccgtattcaacatccctaagctgcggatcagtaaatagctagggatcaagcccccagaaagaaccattgtcactagcatgaaattggtaaaagctcttctgccataaaaatcatctctggagagtgcataagcacaaggcagtgtcaccaacaaattgatggatgttcctaaaacagtgtaatagatcgtatttaagtagccgcgccagatgctgctattgcctaagagagttcgatagccttcaaaggtgaccccttttggcaataaccacatttcccccgagttgactaaatgaggatttgaaatcgacgcactaacgatatagatcaatggatagagaacgattagtaatgctatggctaaaaagaaataaacaaaaaccaaaaagattttatctgcacgtgtatctttcactaatgaagttgttttcattcctataccacctttctataagagactcgaatcgctcagccgtttcgcaatcccgttgactaaaatcaagagaatggaattgatcaacgagttgaataacccaacagctgctgcaaaactatattgtgcatctaaaagcccttgctgataaacgaaggttgcaatgacattcgatgattccatattcaatgggttttgcatcaaaatgattttttcgaatcccaccgacatcaaactaccaaaactcatgatcagtaaaatcaccatggtcggcattatcgttggaatattgatataccaaactctttggagccgagaagcaccatcgatggtggcagcttcatgcagctgagtatccactccagacaatgctgccaagtaaataaccgatccccaacctgtgccttgccagacgcctgataatacatagattgttttgaaccaccgcggttcagtcataaaattgattcttcccacgccgataaaatctagaaagtgattgatgatcccagtggaaggagacagaaatgcaataaccattccgaccattaccactactgcgataaagtttggggcatacgtgactgtctgggtaatttttttgaatggaccatccttgatttcattcaaagccagtgcaaggatgatcggtagcggaaatccgacgatcaaagagtacaaactgatacctaatgtatttttcattagatcccagaagtaataagaatcaaaaaagcgttgaaaatgtttgaaccctacccaaggactttcgaatattcccaaagaaggcatatagtctttaaaggcgatgatcacaccatacatcggcccataagaaaaaatcagaataatcaaaaaagcaggcaggacaaacaaatataactgtcgactcttttttaatttagtcttcatttctttgattttactttttgatgctgacacaggctctctgatcgttgttgtttccattcatactcctccttgtgtttttggtttgtatactaaatatgaaatgaattcgctttcaaagcaatgtgtattttttcttcaatgtgtagaaatgcgaatgccaactgctccaagttcaggctgatgcacttctgatgaagcaatataggcgttttcacccgttccatgaatcgtcagtgattgattggttgctaaatctgtgatcacggatttttcatctgcatggatctccttcagaaaaattcgcggctgcaaatttgttgtgatactgcgaaaggcataatgtgttttttgatctttgctataggtaagatgccaattctccgtccacgcttctggtctagctcgggtctcgtaaatgccttccccatattgttccaaccaatcacccacttcaagcaggcgctgggtctcttctttcgtgaaagttccttctggtgttggacccactcctaaaattaagtttccgcctttactgacgacatcgattaatgtatcgactaactcttggctgcttttaaaggtgtcatggggaacatagccccagtcattgcctataggtatattactctcccaaacttttgttgggatttcttctaaagaaggaatcttgcgttctggcgtcacataattctcatgtctaccgcccatcatgcgatcaacaatgatcaattctggctggtttcgccgggcaatctccgctaagcgatccatctgtaaatcttctttcccctgcccacaccagccggcatctagccatagcaaatccacttttccatagttgccagtgatttcatgaatttgtcgatgaacaaaatccacataccgcgaccagatttctggctgttctaatggatcataacttgcgtgacgccctttgatcgtttcatcatccagccaataaaacggtgagtaccagtccgccttagaataataagccccagtagcaatacccgcttgctggaacgaggcaaaaacttcttttaggatatctcgtttaaaaggactcaatttaccgccaattttgaattctgactccagcgtattgaagagattaaagccgtcatggtgtttcgttgtgaacaaacaatacttgaagccagcttttttacacgtttcagcccactgatcagtatctaattctatcggtgcaaacgctttgatcagttgccaataatcaagacgcaatgtgttgatatcttctcgataagctttattttcccttgcccattcatctttttctgatagttgccatgattcaacgatacccgcttgtgcgtataagccataatggaaaattaccccaaattttaaatcttggaaccattccaaacgcttggccagcatctctgactcagggtaccaacgatcatcctgcttactgtttttcgcagactcaatgtccccacgaattgttgtcaatttatccaacccctttcgccactaatctaacgagaaaataaagcgctatcaatatgtagtttcagcagctatgtcaaactttatttttttgtaacaaaagagcactctttttaaaaaacacaccacttcaattgaagttttagcttacggtatcagacgccatgttcactctagcaatttcacctttctcatttgtaagaaaactgcgggctagcgctcctcgttgtacttttctctttatctagaagacttgctcctgcgggctagcgctcctcgtcgtacttttctctttatctagaaaacttgctcctgcgggctagcgctcctcgtcgtacttttctctttatctagaaaacttgctcctgcgggctagcgctcctcgtcgtacttttctctttatctagaaaacttgctcctgcgggctagcgctcctcgtcgtacttttctctttatctagaaaactttctccttcgcgctagcgctnnnnnnnnnnnnnnnngattcctctgaattttgcgacgaggaacccctgcaccgcaagagcaatactatatcatgttcggatttcacttgtaggagacttatggcacagcccctttttttatttattattgaatgaaggatataaaaaaagggcgtttgtctaccccctcagaagaactcacttagagaagtcgcagttctgctttttggcaacaaaaaaagctgattttcatcagctaatagttaattaaaaaaaatcagacacatggagactcctgcttaaaatacttaaccaatgtatatggactatctattactatcacagcaataattttcgctgtttctagataaaatataattgcactaattatcatgaattatcattttattgcccctttttttcccccaatattatttttttaaaaaaataacattttcttttaataaaatattttattttttaaatttttttttttttttaaatattttnnnnnnnnnnnnnnnnnnnnnnnnnnnnnnnnnnnnnnnnnnnnnnnnnnngtaaaaaacgggacacacaagcagcctatgcttttcttaagcggttagtgaagcagtttgatgaaccgaaggttgtagtcacagataaagccccctctattacaagtgcctttaagaaactaaaagaatacgtcttttatcaagggacagaacatcgtaccattaaatacctgaataatttgattgaacaagaccatcgtccagtaaagagacgcaataaattctatcgaagtttacgcactgcctctaccacgattaaaggcatggaagccattctaggattatataagaaaacccgaaaagaaggcactctcttcgggttttcggtctgtactgaaatcaaggtattattgggaatcccagcttaaatcatagataccgtaagggattttattctttatttaaaactttgcaacagaaccaattgtacaatgtgataaaaattcttgattcaatttttggtaaagacaaatttgtgtgttcatttgtttggagaagaagaaatcattcagagttaaacgaagaaaatatttctgtagagcatgaatatatattgtgttattctaaaagcccaaaatacaacgtcaattataaattttcaacatggattgatacaatttcaactaattcagaaagagaagatgaattttatgaattggagtcaatgtatcaaaatgaggctagaaaatatattaacgatctttttaacaaagaagttgtaacaaattatccaaaaccagttacactactagaagaagtgttttcaatttttttaagggatggagataaaatattagatatttttggaggatcaggtactactggtgaagcttgtatgaaattgaatgctgcgaaaaatataaaggttgattttgtaattgtgcagatatctaaaccaaagcctgaaaaaacaatttataatatttccaatttgattgtaaagaggaaccagaaagcgctagaggctattcaagttttatatggcaaaagtaatatgggatttggagtattcaaagacagtttttatactgatgaaatattatttaaggagatagattaatggatatcaccagtcattttggagtttacggagtatgttttaaagataataaattgttgtgtattgagaagaatgccggaccttacaggggaagatttgatcttcctggaggcagtcaagaaattggtgagggactaactgaaaccttgacaagagaaattctagaagaaacaggttatagtatagtgcgatacaccaatcccagaatttatgatgtttttgtcaaagaagaaaaaaaattttttatggttcatcatattatggcactttatgatgttgaaatagacttaactataaaaaaacaattattgccctctttattaggagatggtttaaatgactctgattcggaagtatgggtggaattaagtggaattaatccggaaaattcgtccccactagttctgaaagcaaaacaagaactactaggaatagtaaatatagataaaattatttataacaattggacagttaacaataaatgattttgtgttagttaagagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctttcactggtgccgcatcactgcgtccgtatacatacaccacttcctgcgcttcttcactgaaaattccagaggcattggctggcgtctctactacataccaaccaggaatctctttggcttcactggcatatggtaacccgactttgccattcaaaatcgttgggtcgcttaattcgttgccgtctgtatcttcatatcggaccgtaactggtgccgcatctgagcgatcatacacgtagaccacttcttgcgctgcctcaccgaaaattccataggcattatctggcgtctccactacataccaacctgggatttctttggcttcactgatataaggtagtccgacttttccgcttagaatcgttggnnnnnaattagtttatataagaggagatttattgggaaggatattgcttgatagatctcctttttggttctgttgcaaagtttttcgatcaagaccttttagtgtaaaatctaactaaaatgacccgggaggaacgaagatatgaacccttttaaaggaaaacaattccaagaagacgtgattattgtggctgtcggttattatcttcgcggttctgttgcaaagttttaaatctactatcagataaggtagaataatagaaaaagatagcaggaggaatgacgatgagtcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgatcgaacaagaccatcgtccagtaaagagacgcaataaattctatcgaagtttacgcactgcctctaccacgattaaaggcatggaagccaatagaggattatataagaaaannnnnnnnnnnnnnnnnnnnnnnnnnnnnnnnnnnnnnnnnnnnnnnnnnnnnnnnnnnnnnnnnnnnnnnnntattatttgtcctttcaaaaattctcctcctcatttctttttattgtaacatatttataactcatgaataaatttctcaccaataaaaaaagcctgaagaagactcttcagacaaaaaaatcgggaagacaggattcgaacctgcgaccccttggtcccaaaccaagtgctctaccaagctgagctacttcccgataatagatattaaaaaaataaaaagactacgcgcccaagaggagtcgaacccctaaccttttgatccgtagtcaaacactctatccaattgagctatgggcgcatattaagaaatgccgaggaccggaatcgaaccggtacggtgatcactcaccgcaggattttaagtcctgtgcgtctgccagttccgccaccccggctgattgcgatggcaaaagcggaaaacggggttcgaacccgcgacccccaccttggcaaggtggtgctctaccactgagctatttccgcgtattcctgatgccggctaaaggacttgaaccctcgaccctctgattacaaatcagatgctctaccaactgagctaagccggcaatgaagtgcgggtgaagggacttgaacccccacgcccgaaggcgctagatcctaaatctagtgcgtctgccaattccgccacacccgcataggttattactatgagccgtacagggctcgaacctgtgaccctctgattaaaagtcagatgctctaccaactgagctaacggctcatatgggggttaacgggttcgaaccgctgaccctctgcttgtaaggcagatgctctcccagctgagctaaacccccataatttaaaaaaaacgcgtggcgacgtcctactctcacaaagggaaacccttcactacaatcggcgctaagaagcttaacttctgtgttcggcatggttacaggtgtatccttctcgctatcgccaccacactattcaattgagtaagtattgctcactcaaaactggatcgaagaatcaaaactcttccgagtttcagatcggaagagcacacgtctgaactccagtcactctcgcgcatctcgtatgccnnnnnnnnnnnnnnnnnnnnnnnnnnnnnnnctgacagtataatcaataacaatgatattttccaaacacaagctcaagctaaggctggtccagtttggtctacgacttcttttacggtgacaaaaagtggaagaaaggttacagctgtttggaaattgaaaacaaatgctataattaaccgagtgaacgctgtttataatattggaattttgggacaaacgacttctccgggaagctattccccaaaatctggtggtgtgactatttctcaaacttggacgtataaaaagatcggaagagcacacgtctgaactccagtcactctcgcgcatctcgtatgccgtcttctgcttgaaaaaaaaaannnnnnnnnnnnggcgctgcagaactagcagctggtgcactgttgtgtcctggagcatcgatttctactaatacatcaccaacattagcaactgttccttctgatacaaggatattttttacagtacctgtgactggagatgggatttcttcaactgatttgtcgttttgaacttccaataaagtgtcatcttcattgatggtatcgccgggtttaacgaaccattttacgatttcgccttctgcgatcccttcaccgatatccggtaatttaaattgaaatgccattttctattcttcccttcttcaactattaaaagttcacgatttctttcactttgtcttcgatatctttagcatttggcaaccagatattttctgcttgaccgaatgggaagattgtatctggagcagatacacgtccaattggtgcttctaatgaaagaaccgcacgttcagaaatttcagaaacgacttgagcgcctacgcctgcttgtttttnnnnnnnnnnnnnnnnnnnnnnnnnnnnnnncagtcctacagacgaattacaagtcatctaataatggataaaaaagcaccccgaaaaaatcaggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaaaggttttggagcttttcccgaaagatcggaagagcgtcgtgtagggaaagagtgtctgcgcctgtgtagatctcggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacttaccgccccccaaagcatatcggtgttagtcccgtccttcatcggctcctagtgccaaggcatccaccgtgcgcccttattcacttaacctttgaccttacggtcgctgagtacttcttctagcgatagaaggttgctcaagaaaataagcgttgaacttattaaaaaactctttaacttgtcaactcggtgtgtgttacttgttttgattttcttcgatatccagttttcaatgaacaaacttaacgacctctgtcgttaatggagcctagcgggatcgaaccgctgacctcctgcgtgcaaagcaggcgctctcccagctgagctaaggccccgggtatttatctttgagagtaaacctctcaaaactgaacaaaggcaaacgatgtgtagtcttccgtactattccttagaaaggaggtgatccagccgcaccttccgatacggctaccttgttacgacttcaccccaatcatctatcccaccttaggcggctggctccaaaaaggttacctcaccgacttcgggtgttacaaactctcgtggtgtgacgggcggtgtgtacaaggcccgggaacggagtccaaaaaaaaaaataaataataaaaaaaaaagtaggaggaaagaaacatgaaaatattgcttgtttgtgcaggaggcttctcaacgacaatgatgatggagtcaatgaaaaaagttgtcaaagaatcaaaaagcttagatgaaaaagactatccaatggaggcaatcggtgtcgacaaattggaacgctatatcaatgactatgatgtcatcttagttgggccacaattgagtcacaaatatgatttcattaaaggggaagcagataaagtgaacaaaccaactgttttattaacgtcggatatctatgggtccatggatggggctacggtaatgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaaaaaaagagttgacattcgcttgttaatctgatatgaattaaaagttgctaacgcagcgcagtagacctttgaaaactgaacaaagcaagcaaacgaaccaatgtgtagggcgcttcattatatgaagcaaaatacatgcaagcaatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgagagtgaagaagggtttcggagcgtaaaactcnnnnnnnnnnnnnnnnnnnnnnnnnnnnnnnctacttgtctgtttatttccagaattttttacgactaagcgttgaccaggataaataaagtcatttttgatattgttccagctgcgcaattgatccatcgtgatgccatgcttattcgccacactccaaaccgagtcccctgaagcaacagtataactaccagcacttgctgtcgtggtagatatggtccctgtattcgtcgtttgtttggcagtaccaccattgatcgtcagtttttgtcctgggtagataaaattattgcgaatattgttccagctacatagctgatccattgtgatgccgaatttattagcgattccccagacagaatcccctgacgcaactgtatagccttgactaccagaagaaactgacgatgtcgctgctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgatcgattagtatcagtccgctccaaccatcactggccttccacttctgacctatctacctgatcatctctcagggatcttactttcttaaagaaatgggaaatctcatcttgaggtgggcttcacacttagatgctttcagcgtttatcccttccctacatagctacccagcgatgcctctggcgagacaactggtacaccagcggtaagtccatcccggtcctctcgtactaaggacagctcctcccaaatttagatcggaagagcgtcgtgtagggaaagagtgtctgcgcctgtgtagatctcggtggtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgataaacgttccattgcttgtcttttattttcggaccattctaacatgcttcacactctttcctaattttcatatggataaatcgttacacctttgaccacacgattgactgttccacttggcgatggtgtatctggtgtattaccaaccttcaccgaacaaagtaatgcgatcgtttgggctaccatgatatctgctaaagcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtattagactgaaatttaaactattgttgggaaaaaaaagtgttaatactgttcagattataactacaagcattcataatacttaattgtatttaacgcatgaatcaaaagatgctattgctaaaaataaatataaatataagagttctgatataaagctatttaataattttgatattgatcgctacaatacacttgacgtcgaagaaaaggatgaactttttgaaataatctgtgaaattgtcgaaaaatatcagatagctaatattttagagttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttaccatccatatccaattcattcgcaataccaaaataatctaataaagttgcaggaatatcgatcgtttggcttaaaacagaagtatgggtatccacttcagcatttgggtaactgataaaaaatggcaaatggataatttcttcatacataggagcaacattctttcctaaccaatcatgctcaccaagaagaaaaccatgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagataaaaaaaaaagcaaaaaaagacatgtaagaaaaaatagataatttgaaatccaaagatattgctggtaaaaacattgggaatatgatgaagccaattgaaaatgcagctagtaccgctctttctaatcatcaagaaaacaagaaagaacaaaagattgtcttgcctgtgaaaaaaccatttatgaaacaattagattcgattactttaagacgagatattaatgattatttttacgtttccaaaaaatatgatccaaatgcaactaaatatcaatttgagcgttttgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctttgttttggctggatcgatggcgtcatgcaaaagattgatgataaaacatacaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaatatttttttttaaaataattcttcttttcgtatgcgattaaacaaatcgattatnnnnnnnnnnnnnnnnnnnnnnnnnnnnnnnnnnnnnnnnnnnnnntaaataggttttcaattcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccctattttcagtataaatctgaaaatagctgccgtgtttgtgttattcgtttgtaaagcgaatagctaatgatttctgcaatgtgaaagaggaggcttatttcgaacagaataggttgctatggaaagaatagcgagaaatttttcttcatgataaaatgaatgagatcggaagagcacacgtctgaactccagtcactctcgcgcatctcgtatgccgtcttctgcttgaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttgtttttttttttcaagcagaagacggcatacgagatgcgcgagagtgactggagttcagacgtgtgctcttccgatctgagcgattagtcggttctatcccaaagctcgttttcaacattgttgtgtacacgtttcccgtaatatcagtcacaaagtgcgtgtcgatgatcgtaaggaagtctgtgatgattttaaaatggtgtatcaagcctcatctaaagaggtggcgttggaagcacgtggtgcttttgcggaaaaaaggaaaaccagctatccaaaagtggttgaatcgattctttcgaacgatcacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgactggagttcagacgtgtgctcttccgatctaggttcaattcattttgatatctaactgctaaatccgttttcttgtccattcctttcccccctcacattaaaaatataacaaacactaacctaaatgtaaacaggtagtgttagtagtcacacaaaatggtgctggtagtcatacaaaatggtgttggtagtcatacaaaatggtgttggtagtcatacaaaatggtgttggtagtcatacaaaatggtgttagtaccattctgtatcgcctgggagagtaaggcgcaaaaaccccctaaaagggtttataaaaggtattataaaagatatataaaataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaagacactctttccctacacgacgctcttccgatctgaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtattttgctttatattttcttctaacaaatactgaattaagcgtgtttctgctctttcagtcgtgattcctacagttaatcgttctgtattatcaagacgtctcgccatttctgataaaagttctagagctatttggggatgcgatagtaaaatccgcttaaagttgtccttttgaatggtacatactttagttggtgatattgcttctataaagcatccataatgttgttcttcaaataatgccagctcgcccacaacatcaccctgttctaaataacgaatcacctgttctttacctgaagaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctttcaatcccaaggtggaagtccaccaaataagcaaagatattttttaaccaaaataatagggccaatatgaaaaaaaagcccattcttgtattcacaaaagtggatactctattttttttcaaaggaatcttcctctctctttccagcttaaacgaataagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtaagtttgtttgtgggtttttagaatcacttttatcgaattcattatttaaaacaaagttcaacatttttgagtgaatcgctgattgaaattcattgattatctcaatttcaaatgtttttctgtaatctaatcccatgttgtttgctcctttctggtttcgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccacttctttccgtctattggtcgtattgatttaaatgataggtttcaattacacgaatgattttctctgcataatccggatctgtggcataaccagcttcttgcaatgctttggcagctgttttgtagtctgttgccgacaaaacatttacatagagcgctggattccagtctacaccattgacaaagagcatcgtgtggtcatccatggactcttcccacgaatcatagactcgaaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctaatacttctttttttactccgcgagtctgtaattttgtttggactttgtcaaaattttgccgaatcattttaatatctaacataattcttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaggaggcgaccgccccagtcaaactgcccatctgacactgtctcccagcccgataagggctgcgggttagagtggccataacgcaagggtagtatcccaccattgcctccatcgaaactggcgtcccgatctctacggctcctacctatcctgtacatgcggtacagacactcaatatcaaactacagtaaagctccatggggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaaaaaaagaaaaaaaaaaaaaaaagagaaaaaaaaaaaaaaaaaaagaaaaaaaaaaaaaaaaaaaaaaaaaaaaaaaaaagaaaaaaaaaaaaaaaaaaaaaaaagaaaaaaaaaagaaaaaaaagaaagaaaaaaaaaaaaaaaaagaaaaaaaaaaaaaaaaaagaaaaaaaaaaaaaaagaaaaaaaataaagaaaaaagaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttattttcctccaatttgttttttacaaaagattttttcttgatcgaactgcaactagcttcgattgtttcttactactccgatcgtttgccggtcgtattcgccacatctgctctagcttccgagcaagtgttactgctttcgattctgtacaggtttggctgatttgatatttgacatcgccatttacgtccagaaattgaacattccattctttagagctctccatcatttggttccagatcggaagagcacacgtctgaactccagtcactctcgcgcatctcgtatgccgtcttctgcttgaaaaaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggcgacggcatcaatgcttggcccgattttcatgacagtaaaaagtaagaaggttattaacgagtcgtcaattgaacaatgaaagagagaatgatcaatggatattcagttagaaaaagttacctaccaaacattaccgatagcgtatcggatacaaaaagaaagttttaaacagttgtttgaacactatcaggatacagaaacctccccttatctggaaacgtatgagaatttctctaaaaagtaccaacgagagaataattatttcaatttgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgaggcaatgcctgctggtttgtttacaatcaaaagatgctggtcttcataaacgatctcgattggcgtctcatctaataagaccgtttcatgttcaccttcgtctgggatcacaatggttaccgtatcattttgcaccaaagaatacaagacattttgtctttggtcattaacaaaaatcttgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaacaaaaaaaaaaaaaaaaaaaaacaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaggaagcccagcaaagacgcaagaatcaatcgcacgaatcatcgccagcctccgaggatcattcaaactagttgagcttcttgaaacattgaaatttcctaaagcaacctatatgtattggcagaaacggtttgacagaccaaacccagaccaagaaattgaagaaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctattgggatttatattgggcgatttacccgtcttaatagtacagatatttttgtgcgtcacaatcaagcgcttcaaaaaattttcgctgattttgaagatattgacaatcgatcgatcgtacttttactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagtaacagtgactcgacaagtacaagtacatcaatcagcgattcgttgtctctgagcacaagcatttctgcatcactaagtgcgagcgattccgcaagcttcagtggtagcacaagtgtaagtaacagtgagtcaacaagtacaagcacttcgatcagtgattcattatcagtaagcacaagtatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacggatttgtctactgcaaaagcaactcctgcagatgtttattttacaagccacgaattattgaatgatttgcaagcttccgtcaaagcacctgtctatcccatcaaaaaatatatggatgtcgctgaagtcaaaatgcaaatggaaannnnnnnnnnnnnnnnnnnnnnnnnnnnnnnnnnnnnnnnaactgccgccagctgactatatgtcgtagccatttcggaagctgaatagattgtttgagttgcgaagtcttgtaattctttttttacactagcaatttcctttttccccatgccaatgttttccatattggcattgaacgttttccacgttgcagatccttcattgagatctccaactaatcctgtaatagcacccgagatcattgatattcccttttgtgctattgcataggctgcaccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtttctctcattcatgagcggatttgtagcacctccgaggaaagataattgaaatgactttagcaatagaaggatttaaacaaaactttttgacttggaaataatttttgattaatataggggtggggggtacccctatattaaaggaggagtcgacatgtcacannnnnnnnnnnnnnnnnnnnnnnnnnnnnnnnnnnnnnnnnnnnnnnnnnactatcagctgatacaatatccttccacccaaaaaaaacaacaaacattaatcccactaaaataacttttttcataacatatagcctccatttaatttgattttttaacgcgaatttctagtatattatccataattcccgcttaaaacataagaaacgcatagtttacataggtttgtatttgtaatttattcgtttacaagtcctaataagtcttattatttttaaatttgattctatttttttttattttcatactttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcaaaaataaaaaaaaaaaaaaaaagataattaaaaaaaagaattattaattcattaatgtccataaatataaaaaaaatatttcttttaaaagattgttatcacatctaatattctcaaaaaaaagttttagaaaaataaaaaaaaataaaactgatattatttacgtagtaatcccacctaattcgattgcaaaacaagcattactatacaaaaaaaaatatcctaaaacaaaaattgtttttgatttaattgatttatggcctgaaacaatgccttttaagaaaaatttttctccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttacgcgcttgatatgctccatcaaaataaattctcatcaaacccgttttagacacaataactttattaactactctcatactatttagcccataaatagacccatacttccttacaaatttacctaactctaaaatattagctatctgatatttttcgacaatttcacagattatttcaaaaagttcatccttttcttctacgtcaagtctattgtagcgatcaatataaaaattattaaatagctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcttccgatctggtgcaaatatcatcgatccatttatgcaaacgattaacattccagctatcgaagcgaatacgaaagcgcttgaagcaggagacaaattgccgtatattgtaaataagccgttttttgattcatttgttaatataggtggtaccggtgcaacattaggcttattgatcgcaattttcttggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttgtccgaccatggtgtagagcagctgaagctgttctttccaagactggatggtggcaatcgtttcttcaggtcctttatctaagagcatggtcaaaatcgtagcagagattccgacacttttggcaccaagacataaagctttgaaaatatcaaaggcatctcgaatccctcctgaagcgattgtcgtgaaggagtgttgcacttcgttggcttctagtaaagaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcaagtccttcttagcgaactatgcttagaagcgactgcaggcgaagcacagagtagacgagcagatgatgaacagtactaggggaccgaagggaacgtagtcaccacgtcccgaatcactgcgactgacatgcaaagcatggcaggcaagacgatgaacagtactaggcgaccgaagggaacgtaggcaccacgacccgaaacactgcgacagacatacaaaaaatggcatacaagtcgatcgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtaataataccgattttcattggtgttttggtatctccgattgctcgtagcatacttcctaaagtagacatcgttgcaataacaatagctccgccccctacaatactaaaaaattgcagggaagaatcaagggtttcttttgtcgctcccatgatcgttaaaagctgagatccagctactaaacttacaattccaagaaaaagaacaaagatgattgccaacaacaaagattgcttagagatatgctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattttcaattctgccccttttttgccccttgacctgttatctattcaaaataggtcttccaaaaggctatctaatagggattcaatcagacacatggagactcctgcttaaaatacttaaccaatgtatatggactatctattactatcacagcaataattttcgctgtttctagataaaatataattgcactaattatcatgaattatcattttattgcccctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaattttagaatatggaaaattataaacaggcaatgattgatgatgttttggcagagattcacgagctttctttgaaaaaggagatagaggatgatccattgtatacgttttggcttaactattatttgtttgccagccaaaataggaacttattttttgcgttatttttgaatgatatagggtgtggttcctatttaagagatcaatcattgtcattgtttatagagacaatggctgaatccgaagtatatcaaaaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggagttttaacgacagctttgcaacaaaacaaaccaatcactacccgatggactcacggattgaatgtcatggcctatttaagttggatctttgccactttcttaggagcgttgttagggtcatatattcctgattctgaagcattaggactggactttgcactagtggctatgtttgttggcttattcctttttcaagtagaggtgcctttaaaaaagaagaccaagcagacggtgctggtgctagccgcggtggtaatgtcattggtactttttatgagaatttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttttgtatctttttttttcttttcgttcagttttttttctttttgttactgccttttggtatacgtttgaagaaaataaatcttgtattttggtgttatcttgttccaattttgcgtttgtcattacggtcaaaacagacaatgaatctaatatttttttttcaaataattcttcttttcgtatgcgattaagcaaatcgattatgataaatcgcatcagcgcactatcatttattgtctcttcgacaggtaaataggttttcaattcttccaaagcgtccctatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgattttactgattaacgtattgatcgatggcattaacgcaccagtagagaagcccaaaagaaagcgtagaacgcccaattggaatggtgacgtaacaaagcccattggaataaagcaaaggaatgaaagcagtagtcctcctaataacactttatgatttccgtagcggtcccctactttacctaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatagaagaaaagaagaaaaaaaaaaaaaaaaatattatgagctaaaagcggatattcagttgactaagtgagtaagagcaataacaataaagtaaacatgcagaaagaagcaggtgagtgtttgactatcaaagtaatgtccgtttttgggacaagaccggaagccatcaagatggcgcctttggtaaaagaattagaggctgatcctcgatttcaatcaattgtcgtggtgacagcccaacatcgcgagatgttagatcaagtattagaggtttttgcgatcgaacctgattacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcgttgttgaaggtgtgaacgtcgttaaaaaacaccaaaaaccttctcaaacagctcctcaaggcggaatcgtcgagatggaagcaccaattcatgtttctaacgtgatggtggttgatccttcgaacggtgaagcaacacgtgtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgggtgtaggcatgaatctgaaggtggacggcaaagcatatgtcgtaccaatggctacagaagaaccttctgtgattgcagcaatgagtaatggagccaaaatggctggtgagatccatacgcaaagcaaagaacgattgttgcggggacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagattgccatcatgtctaagagctgatcattggaatattgtgtaaatcctttcataattcgaacaaaggtatactgatccactagtttaaaaattgtgatcccagaaccaacaataataaaaggaatcgcttctttgatggtggataaaaccaattctttggtttggatctctgtttcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaataaactgtttggatttctgcacgagtgttcgcgtgcatttgcaggatacgaccgatacgttcgcgtttgtcttttgaagcattcaagacatatgatccagagttcaagacacctgaatacacacggaagaatgtcaaacgaccnnnnnnnnnnnnnnnnnnnnnnnnnnnnnnnnnnnnnnnnnnnnnntaaggcatcaacttagcatctgacaaacggcggtattgggttttagagacaccattagtcacaacatataaatcaaacttgtcagccaattcggccaacactagctgactattgcctaataatttatgcccttgatccaagtaagaacgatagtgtttttccatcgcttcactgtcgacgattcgcccatactttttaaaaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacaatcgtgggagacgatgaattcaaacttgaacaaatcaaagatgtgttaagcagcaaactcatcaaacgaagtgttccgacaaaaaatatccaattctcacagactgaacatgcacttggcgccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttacggagattcagaggaagactatcggtatacagacttgcttgtggcgaccattcatcaactgctgcatttttatcgggcatttgatctgataatcgttgacgaagtagatgcttttccttatgaaggggaccagcaactaaggttcgggttaatgaatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttctttatggatnnnnnnntgaggaagaactactttctgcaggagcagtcgccttggcagaaaaacccctagatttgctggaattgatcagaatggatcatgctggaaaataaatgcaaaaaagagcttagaacagaggaagaaaggtgattatccccgcgatgtttgattagtagcgggacttacttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactaagttttttctcttttctgtcaatgaaacgctacaaacaactatttattaattaggaggcccaccatgaacttttatgacaaaataacaggtaacgacatgaataagcaacaaaaagaatttcaacttcgtattgataagttacccgctggctaccaagatgcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacaaatataaaaatacttgaatggaatattaatcaacgttctagtgaagatagcaaatttcccaattatgttatctcggaaatttctcaaaaaaatccagacgttatagtgttagttgaatttaaaggaaaagaaaataagtttagattagataactctttttctgaagattattttacatattcttataacggttcaaagtataccaataataagaatgatgttaaaagaggcaacgggatttatatcgcataaaagaaaagaatatttaatgagttttatatggaagatgtattttgggaagaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttacttgaaaacttgtacaattgcatcaaccggatgctttagcgcatagctaatggatctgccactgaaagaaacaagagagcaaaacagtgttcctactatcgcaagagtcaaaagtcctttagttggaatcgtcatcttctcacctaaaggagttcgtttaaggttcttctgaatcatttgttcagatagatgctgctctttcagcaagctatcatcttggcttttttcagctaatttttctatcttaaatgccttttgattttctttttttttttttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtattcaagaagggggtgcgggggaaatgagtgcgaaacagttacgtatcacgaaagaggatgccgatgtttattctttaatgttggatgaagcaatgcaagaaggggagccgttgatcgttcagctggatctaaaataaagtcaaaaccagccgtagaaaaatttttttcgaccagtacaaataaaaaccgattttctttttttagaaagtcggcttttaataacgaagctaatttagttgaagtagttgctcaataatcgaagagctgcctggtaaaaataaaagtagactacctatgactaacaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttcttttctttttttttgtttttttttctttttcttttttttttttttttcttctttctttttttctttttcttgtttctttctcttctcttttttttttttttttttttttcaagcagaagacggcatacgagatgcgcgagagtgactggagttcagacgtgtgctcttccgatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgaaccagcgattgttactcaagcaaaacagctccaatcagagatccaagcagggatcgatgcgtttggcaaaaccaccaatcaagcgggtcaaacgatctatgcctatgaagtcgatggtcaaggcaatgccactgtgatggatgatagcaacgtaccgaatttggttgccgccccttatttaggttacggatcagatcaagatgaaacctatttagccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgtaaacaaaagttaagttgtacgtcttaatgctttttttgtaattagctttctgaaattttcaaaaataaaaaaagagacttgactgtctcttaatctttgctttgaataacagcaataattcccgtttcaaatataaaggatgcttcatccgttatgaattcattactagcaaatgatgtaggatgttcaaccttcacattttccaataggtatttgctttccattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaaccaaagcggtgcaaatattgcttttgccggtgaattcaataatagtttcgtgaccattggcggttcaggagcgacactgggcatggtgatcttcatcgccttctttgctaaatcggcacaactaaatgcattaggtaaagccgcgatcgtcccatcattctttaacattaatgaaccaattttgtttgggatgcctgttgtgtataacccctatacggcaattcctttctttttgtcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctctcttttttataaataatttttaatttcttctgtagggatcgtaacgatcttcgcttgaccgattttttctaacaaaataatcttcaattggtttcctcgggtctttttatcatgagtgatcgcttgatacaactgatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatcattaccaatggagatgaaatcgcagcgacaatattatctcaatatggggaaagaaaagcacctctgattatcggtcaagaaaacttactgatcagtcgattactgaacttttcaaccgttgaattccatttgcacctctgtggacgagaagcgttccgtctattccaggaacggagtagggaacaaatcgttttaccgtttgaattgcttgttcgcagctaagcaatgctctaaaaatgtgttatcaaaatcaccattcttttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaaacgccacaagtggagtaggaattcgtaaaccagatgttgataaagatatctacgatgtattggtgaatgaaacaccaatcgtagaggcaatattgccaagtagtcgtgagaatttagatattgttcctgcgacgattcaattagctggtgctgaaattgaattaacttcaatgatggctcgggaatctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttttttaaatttttttttggtttatattattccagctttattaagttactatgatgttattattttgatgaatttctttagagatgttcctacgtctttagaggaatctgccaagattgatggtgcaagtgattggggcgtctttctaaaaatatttgtgccattatctaaacctgctttagcaacgattgccctatttcatggagtgtggcaatggaatgattttatgacaaccaagctatatgtgacagacagagcgctttatccattgcagatgaaactctacgaaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgattactgtcttggatgaattgatggtcactgcgtttggcagtgattttgaaggtctcagtccctgtatagatttcactcatcactgtttgtacggcttcttttaacacttcgacgtctttttctacccgaatgctgggagaaaaattttgaatcccaaacactttttgcaatttcaatataattgcctgactgtcttccccattcagaagcaaatgcatccgatcactttctgcatgaactttgcatttaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcactttagctgtgatttcttttgatcctacgattgcaggaatctcaagagatcgagccatgattgctgagtgagaggtacgtcccccgatatcagttacaaaagctttaacgaagttgcggtctaattgcgcagtatcacttggtgtcaaatcgtgagcaacgataacaacttcttcgttgatcattgaaggatttggcaacgtcacatttagcaaatgtgccaagatacgtttcgcaacgtctttgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgaaagacggtgagcgatcacgaaaactgtccgaccttgcatcagccggtccattccagactggacgatccgctctgttcgcgtatcaatgctggaagtcgcttcatctaaaatcataacaggcggatcggcgatcgccgctctggcaattgctagtagctgtcgctgtccttgcgacagcccttcgccatcccccgtgattacggtatcgtacttctcaggtaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtgcagtcattgtcggaccagatcaattgatcactgaagaccttgccaaagaaatcgttgacgcaggaatcgaaactgtttcgatccgttccgtctttacatgtaatacaaaacatggtgtatgtaaacattgttatggtcgtaacttggcaactggttcagaagttgaagttggtgaagcagttggtacgatcgctgcccaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccccgacagctgaaaaagggtgaaagaaaacgaatctgaaaatggcttttgagtgggtgtttcgagaacgcaagttttagaagcgcacggatgtccccgttactgagaccccaatatcacgcaacagcgtcgcattggagtagaggcattcttcgtaagtcggatgcaaactaaggtggtaccatgtaaatttattacatccttaagagataactcttaaggatttttttttacccaaaaaaggaggagaaactatgtgccaagtgatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccaaagattctaaactctctaagaaactcccatcatagctgaatcgaataattcggccaccatgttcgagttctttttcaacgaccgcttctaagcgaccgtcgccaaaggtgatcttcgtaccgacttttgctcgcttggcaggtttgattaatgtttcccaactgtccccttcgatattgtttaacaataaaatctctagatgagcgccggtctcgattttctcgccatagatacgagcgggcaaaacgcgagtatcattcatcacaagggcatcgccaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactccatcatgtctttccctaattgaatgtccgcttcacttaatggaaaggggacttcttttgctacttcccgcaaagttgggttgccttcgcgaataatatcatccattgtaatcattgatgatgtgattcctcctactatgtaaaaattacgcgctcgttgactccttataaagtgtaccacaactaatggccgaaccgcattagaaagtttaagggacaactttttcttaaannnnnnnnnnnttaccttggagcaggtcttgttgctgttgcaatcggaatgatcatttttgcaccgactaaccgtctgactgcggatcaaaacgaattgaaacaagagttaagcagtaatctgaaaaagatagagaatcaacccaatcaaaaaggaaatatcttatttctaggggattctgtgatgcttggagcatatcaagaattggaagatacgtttagtgggcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatagcactggctacccccgcgttaatggacgcgccggcgatcgtaccgacccccggtacgaacttgataatattccccacagcgcttctacctaaactaacaacaactaattctttagaaatgctttttgcgattccctcgacccacgattgaccaaacaacttgtgtagtctagccatcatcgtcatttgaacaggtacaaggagtatcgcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttacctagctgttttgctctttttgccgtaagtcttttgataccaaaaataccctatctggatagttggagtgaaacactttttcatggaatagaggaaatcgtcttttttcttggaagatttgccctcacgactggaaggattcccttagaacttgctattttctgtagtcttcttggtttatttttttatcatcggcatcagttctttttttgtttcttagtcagtttgtttttaccgctactttttcctcttctttttttttcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttggttaatttcgctgttttgatgttgcatctttctcttttttgtgaagagtttattctttggtgcagtcatgagtttcaattcgtggaattgacggatactttctctacaggtagttcaatcatgccgcaaaaaaagaatcctgacatggcggaattgatccgcggcaaaacaggacgtgtctatggcaacctttttagtttattgacggtcatgaaaggtctgcctttggcttataacaaagatttccaagaagacaaagaaggcatgttcgataccaccgaaaccattgtgaaaagcttgcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcacgcatttaaaagtggtgagacccagaaagctagaaactatcaattaagtattgaagactttcgccgtatcttaaagttcggtacagtacccagtgtcctaaaatactgcgtaggttggatgggaattcctgtcggtgatcctaagctgccggtgctgccagtagatgaacaggactatccagagatccatcaagttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgacagctaacgctacccgaattgctgctatttttttatgctctttcacgggaaaaacccaccttttgttttcaattacttgaagtataatgaaaagtttcttttctcacaagatgctttttcacttcttaagaaattaagaaaagggttcctcattaaatagtttttagaaaaaataaaagcattcgcaaaaaagtgacatacttcaggctttccaaagatggaaaaactgaagtatgtcatttctaaccattctactttttcttttatatttattcttatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcagcggattatgacaaatttattgcttggtgccagacagttcctaaaattatcggcaaccccctttacgtctggacccacttggagttaaaacgtttctttggtgtcgatcttatgattaatgaagaaaacgcgccagaaatctggcaaatcgtcaaccaaaaattgcaatcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccatcatctttatcgatgaaatcgatgcggttgggcgccaacgtggtgccggcatgggtggtggacatgatgaacgtgagcaaacgttgaatcagttattagttgaaatggatggatttgatggcaatgaaggagttattgttattgcagcaaccaaccgttccgacgtgttagacccagccttgttacgtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcggtaattgcagtgaggttcattttttgattccattcaatcaaccgatcatagtaagtagcaaattgcttgagctgttcagatgacaactcaattccttgaatagataattgtttttgaaattcttctggcagcataatgaatcctttctatttttgtgaaacagaaaaatgtttcacagactaattcctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcatacaatacccgaatagcagccacctgggcctgtaactgtgcactttgctgtaaaatatgggtctggacagtcagaaaaaggaagacactcgtcgtcagcaaaccaaagccaatgatactttctagcatgatatatcctttattcgatgatcttatcatatcgtccacttccaaaaagaaatttgtaggtaatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaataaaatctttagatcggaagagcacacgtctgaactccagtcactctcgcgcatctcgtatgccgtcttctgcttgaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctcctactttaattgaaagagagtctttcactgagaatcagaacatcatcaattactagatcaactgatttagcgtttatttaaggaactccggctgttttaaggccgaggtattaatggagagggaaaaagatggaatatccaaatagtcacttagcgatatttattattcgggaaaatcgctttattgcccgctgtcgattgatgtcaggggnnnnnnnnnnnnnnnnnnnnnnnnnnatccgctgctgttgagaattgctctttattttgtacatctgcatacagtcagccctcctgagatagtgtactttgttgaagccatcagttttgtcctcctgcatagtggacccaacgaggagctaatttcagattgataaatgttaaaactaatacgattaagaaaaggatcatcgacatcgccattgcataccccatatcaaaagctacaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctattctaccaagttcctcgcaactcaggtgcattgtatcaagtttcttccgttttagatacctacatctataacggcttgacggccacaggtgactttggcatgactgctgccgccggactttatcaatccgtagtgggtatgtgcttgctcttagctgccaacttagtggtacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttatagagaggatgattattgattgcatgttccatctatttgtattaatatagataatacaaaggagagagcgccagtgcaattcgaaatcaaacctcaaagcaatacacccatctatcaacaattacgcgatcaaatcattcttgggatcgcaacaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaatgttgtaaagatagtatcaaggttcgctggatttctttatatcttctttatacgatgagctgtaacacaatctgtctgtttacagcgaattagcggatttatcttcttgcccaccctgttatatttggttatacttgtctcacttaatctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaattaacgaagttcagttaagccgcaacgagggtggcggtttgtatatggaaaaatacggaaatacagcagtaggcaaagccagtattgccaattcattgcttgacatgattcaacagggattgaatcccggaaaaaatcaatgctatttcattgcttatggtcaaaagcttcaaatgtcacgctcttactttggaacacaagcggcattgaaaagacttgatgaaatcgaaaacgtaaaagcggaagggattagaaaaggcgatgtttttagaattggttcagttgaaaaggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagacgccaatcaagcgacgcacttgcatctagctggagatattgcaaacaaagagacagcagcgatgaccgtcattgatttctttcaaagacagctgcctactacctttcattggggcaatcatgaaatggctgatttatcagaatcattgatcgaaacctatcctgatccagctttcttgaactttcaaacagtcgctttatcggaaaaaacactcttgttaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaacaagatgctaatctgataggagcagtggcaaactatcacttacgaaaggagcaagtttaatgtatgcaatagatgcaaaaaaaaggtggcaaaactatcaagggagtcagcgagagcctgctgattttgaagctttttggcaggcagggtttcaagaggtagatgatttggggacagactatcatttagagcnnnnnnnnnnnnnnttttcttttcttcttgttcttttgttttttttttttttttcttttttttttttctcttttttttttgttgttttttcttcttttttttttttttttttttcaagcagaagacggcatacgagatgcgcgagagtgactggagttcagacgtgtgctcttccgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcaatttgcgtgtcacacgatcggtgatgactagaagaatgacagaaatgattgctattcccaagccaaccgctgttgcatatgagaaatcgccttgtgtcagacccattttataaacgaatgagttgatgacttccgatttgttttggttttgtgaattcatcaaaaccaatgtctggtctaaattagatcnnnnttttgttggagggtgctggcgatattatccatatcattgattgcccgtgacatgatatctccgtttgaatgggtatcatagtaagaaatcggcaagcgattcattttttcttctaaatcacgacgcagttcatagacggtccgttgtgatacacgggtcatgatgaattgttgcaagaaattgaaaatagcagaaataacatacataccgatagcgatcataatgatttgtcctactttatcaaaatcgatcggaaattcggagacagtttttccagctttctttttctctgccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccatttcgatcggcttgttttgataaacatctaaaccgccgcacaacaattctaccaacatcatgcacagttgtgggttcatctcgatcatctggatcccgctcaaaggctgcgaatgaaagagccccaataaagtaaattttggtatcgaatggataaattcgtcataactgacttgttcgatagctgccaactgcaaagaaacattggtccgcagttgggtagaaagcatgctgctgctcatcttcgagaaatcctcgaagatcatgtgcagggtattgaggtcctctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatgcaatcgaatcaatctgcctttagtggatcttttttcttcaatcaatgtggtgaattcacaactagatgaacaactagaaaaagctgaattttcgctgattaccagtgaatttgaacaattggctcaaattttggagaaaatcgatcccaaaacgatcaaagacgccgatttaagagctcgttattattatcttaaaggattcgagatggtttttaaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggaaaaatagcttttcttccagaattgcctagttcatttaatctgttaagcggccttgacttttgctttaaggaccggatagcctacgttttcgatagctttttgaatctcttcaatcgaagtgacagctgaatcaaaattggttttgactttgctggagttgaataatactttaatgctgtctttatcaataccgttaactgatttcaaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgaataaaaaatcgtctgattcagcatataagtgtatgaataaacattgatgtgatgaatcaggttatttttattaacaaattcttgaatctagaataaaaaaacggtaaaaataattttaatcgataaaaaatgttatttaattaacgtacaattttttaggttgttagatcagtgatttcctagtatctagtaaaaaactctcattttcgactcagcatatcgccattttacaaaacataatctaagaaaaataacataataaagaaagcaaaacggaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaatcaacggctgtagcgatcatgtcaatctacggttcactcgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaataaaataaaaaagaaaaaaaaaaaaaaaaaaatgaagtaaataaatctgaaaatgagcatctaatggtcacatcagaggatcagacgatcatgtatacgaatggcggacaatttgtcaatggagtctatgatttacagttaggcgatgtcggtttacaaattcctgatccaagtagagtgccagatcaaacatttaaaggaaatgtgacttggacattgaccaacacgccaatgaaacaacattatttaacgaaagaaattcgtaatttatttaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtataagctgcctcatgtttctttaataagcttgctacggtatagatttgttcctccgaaatctttggagactgaaccgcatcccattgaccgtttttcttggcctcttctatttttcttcgaccataatcagtcattagtccttggctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgataaaaataaataagtaaacacgtagaaaaagaaagtaagatgcagtggaatgtctaacagagagccccgacagctgaaaaagggtgaaagaaaacgaatctgaaaatggcttttgagtgggtgtttcgagaacgcaagttttagaagcgcacggatgtccccgttactgagaccccaatatcacgcaacagcgtcgcattggagtagaggcattcttcgtaagtcggatgcaaactaaggtggtaccatgtaaatttattacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgaaaacatttgatgtcgaagttgtggcagatacagtgagggaacgagcgatcgtgcaacagatcgctccccatattcctaaaccagatcccatgcttttacctatctacgatgagcccggtgcaaccttcaatcttttttctgtcaagattgccatggatttgtatgatcgtctggcaaatgtaacagatagtaaatatgccaattatacgttgacgaaagaagaagtattggaacgagaaacgcaactgaaacatgagaaatagaccggaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatttgatgtccttgcatctcaataaattctacaggtaagtcaccaattatttcctttgttagtgcctgttgatctaatgagctgtagtcgatggcaattctcatacctgatgtaagaacagtttgtccctcttctttaaacaacaagacgagatcggaagagcacacgtctgaactccagtcactctcgcgcatctcgtatgccgtcttctgcttgaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaccccccccaccccccaccccccccccccaccaccccccccccccccccccccccccccccccccccccccaccccccccccacccccacccccccccccccccccccccccccccccaccccccccccccccccccccccccccccccccccccccccccccccccccccccccccaccccccccccccccccccccccccccccccccccccccccccccccccccccccccccccccccccccccccccccccccccccccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnntcaacaacgggcgcaaaagaatcaaaaactgctggagtaagaagaagcaatcaagcaaacccaaaaagaaatcgttcagtatgaacattatgataaaccggaagcaaaaaaggatgctttgcgacgagtggctgagttgacccaacaatatgaccagcatccactcgtgatcgcctatcgtgcggcacttcaggaagcagatgaattgctgcactacgtcacaacagaaatccaaaagcaagtgaataaagccatcgaggaggaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaagataaagaaaaaattcgattataaaaaaaaaaaataaaaaaaaataaattttaaactaaaatattattataaatgatttatataaatatagtgaaaacttcacggatgaagaaaaaaaatttttgattaatcgtataaaaggaatatattatacatcttcttgtctaagcatgaactatactaataaatattgtgggaaattaactaattacggaacaagtttgactatgaaacagaaaatgaagttattaattaaaaggttagtgaggaataataaatgaaaaacattgtaaagcaaaaatattattcacttatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacgaattagccttaagtatcgaagagatccacaaagagatcgaattgatgaacgggtatgtcggtcaatcccaaagcagtaatgtccacaattcagaaatgatgttccatgtgtttgaaagttgggagatcgaacggcaaaaccaagcagaattagtggaaagcatgaacgacatgaatgaagatgtccaaagtatcggaaaaattgataagctgatcaatgaaatttctgacaagaacaacttactggcattgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactaactgaaaccttgacaagagaaattctagaagaaacaggttatagtatagtgcgatacaccaatcccagaatttatgatgtttttgtcaaagaagaaaaaaaattttttatggttcatcatattatggcactttatgatgttgaaatagacttaactataaaaaaacaattattgccctctttattaggagatggtttaaatgactctgattcggaagtatgggtggaattaagtggaattaatccggaaaattcgtccccactagttctgaaagcacaacaagaactactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttataatttttttattttatttattatttaatttatattttttttttataaaaattatttttaatttttttatattatttttaaatttttttaaaattaattatttaaaaatataaaaaataatttaattattattttaatttatattaaaaaattttagatttttttttcttagtttattagaaagaataatttttttttttttttttttttgctttttataaaagggggtatgctaaaataagagggtatatagcaactttaaataagagataggagtgtatctttttgggtgcagaattaaatcaaaaattatttagtgcggcagataatctccgtagtaaaatggatgcgtcagaatataaaaattatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaaaaaaagcgtttattttctttctttactgattcaggcttatctaccatatcttgttttaataactgcaaggaagccacatcatccgttaaagaaaagtacggctgattatttaaatagatggaaacagcttcctgttcatttgcgtcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaagataaagtgagttacctaaataattttcagcgataccagctatcttcactgttacagctgtttgatccttatcataaaaggttagctcatctccaatgtggatatcaaaaagctccgcatatttcatcgttaggatggccccatcatctagtgacattttttttccatcggtagagtgtagatgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttgttttagtcttctgtacgagagaaccattatatgtgattacgtagtccgtttctgaaaacaagtctagttcacttaataaatcttggacacctgttaaggggcggccagtacataagacgattcgaacaccctgtgcctccgcagcttttagtgcttggtacactccaggtgtgatttttcgatcattgttcagtaacgtgccatcgatatcgatagcaatcagtttgatgctcataacttcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgattcagctatgatcgaagtgaaaaatgattcagtgaatcagatgcctctttattcttatcagtttactttttatgatctgctggatgaatcacatttagtacgcaacatgaatctgatcaagcctgccgtatggatcgcttttctcagtatcttgctctttagcctgtttgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagataaatctaggacttgatgttttgggtaagcgagcagacggttaccatgaattggaaatggtgatgtccagtgttgatctagccgaccgtctgataatggaagagctagaagaagataaaatcattatcgaaaccaataaggccttcttgccgatcgataaacgcaataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagatagctatgcgaaagaagcaaattacaaaggattagccttttgtatgtggattccagttggtttgttctttttaagtacatttctaccaaccttcttagctattttattaggtgcggataaggtaacgggaatgatcgaagctgttccaaatgtcatattagatgggttatctgtagctggaaatctgcttcctgccatcggatttgctttgttgctggacatgcttttttcaaagaaaatggcgcccttctttttcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaataatttttatattctgacgcatccattttactacggagattatctgccgcactaaataatttttgatttaattctgcacccaaaaagatacactcctatctcttatttaaagttgctatataccctcttattttagcatacccccttttataaaaagcaaaaaaaaaaaaaaaaaaaacttattctttctaataaaataaaaaaaaaaaatataaaattatttaatataaattaaaataataattaaattattttttatatttataaatatttatatttataaacatttaaaatacatataaaaaaattaaatataattttttaataaaaaaaaaatannnnnnnaattggcacatcatcatttaatgtaagaatccataaaattatggtgactaagggtaataaagcaagaccatgggcattagccccaggagatatggcaacagtttccaaggttaatcagattgagtcaaccgttgagggaactattcaaacagtatcttctgtgaaaaatatagctgattcagccctatctaaagcaagtcaaactgaaaccactgtaaatggactgaaaacaactatttcaactgttgagacaaacgctaatacagcccttacaaaagctaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctagaattctttttaaaatcaagaaccccaatcgtgcaaacaaaagacctccaactagccctgcggccagactgatgaggcagctataaaaaagttcccaaaagaccactaacgcaatttctcgtttccctaatcctagaacattgtaaagtccaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcccttgcaaagacagctgtcatggtttccgagattgcttctagaaaagcgctattcgttcgttctccgcgataaagctgatggaagacgtgaccgtctttgatgaataatactcgttgcgcgcggcttgcagcaatggaactatgagtaaccatgatgatcgtttgtccattctgattgatttgctgaaacaacgtcagcaattgatcggaagtttttgaatctagcgccccagttggttcatctgctagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgcggcaatcacctcttgtgcatttaagactgaagcaaaagccacaatagtaatattgttcaattcttcgttgatcttttgcttaattaaactcgtcacacctaaacccgttgaacaaacgtaaaccgctcgaacacttcgcaagtcttcttctctttcgtaggaaaccagaaagtgcaacgcaatgtaggcaacaaaagaatcattgatcaagagtttctcgtttatttcttggagtgctgcttgattgatagcagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgaaaatttctgcttgccggaaaggcaatggcaaatatgcaggcaagtcttgactctcaaagaagacattaaaaatggacgagattccttgagaaaatcctagaacgccaaaaagagcaacataatnnnnnnnnnnnnnnnnnnnnnnnnnnnnnnnnnnnnnnnnnnnnnttcttcactcacgcggcgttgctcggtcagactttcgtccattgccgaagattccctactgctgcctcccgtaggagtctgggccgtgtctcagtcccagtgtggccgatcaccctctcaggtcggctatgcatcgtggccttggtgagccgttacctcaccaactagctaatgcaccgcgggtccatccatcagtgacgcaaaagcgcctttcaactttcttccatgcggaaaatagtgttatacggtattagcaactgattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagctgttttgaacaatattcaattcatggaatctgtccatgccaaaagttattcttctatctttagcacattgaatacaaaagccgagatcgatgaaatctttgaatggaccaatacgaatccctatctgcaaaaaaaagcagaacgtatcaatgagatctataagaacgggactccccttgaaaagaaaattgcgagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattttttaaattcgatttctacttgatttgtcattgttttcctctttccttacagtccatcaagtttacataacgacgggcaatatgtcaaatgaaaacccttggaagagttgaagcaaaaaagagctctgttatttttcttgcaggtggcaccgattgaacattctgttttcctttaagattgtggtaaaatagaaccgtatgttatgaaaagaatcgagggatagaaatgattcgagattgggaagattttttggcaccatatgaacaagccgtctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtaatgttcaaaggtaaacccagtaaagtcattcattgtaccgccatcattgaaggaataaaaaatcaaataaaaaattgggacgtacaataggataaagacaacgacaagataaagatttgaccagcggaattttttcattttcgttgtcctccttttttcttctcacctgtcaggagcatcactaagaacatagcaataatcaaaatcacaccgatcgtcgaacccatgccccagttttgtgtcacaaggaaatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtgagaatagatgaagaaattttggatcggcctgggtatcctaatgatcgttttgtttgccgggttacaaattgctgagaaagtcatcatgggcggccaaagttactatgttcagatcacgaccgatggcgaaaagatcgaaaccgaagacgatcgaggcaatcaagtgatcgaatataaatatgaactacctggttacgacaaagacgcaaagaagaaaaatctggaaatcttagggatgaaaaatcgaccatagaaaaaaaaagcaaaataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctacgttcgcggtgctttccgtattttactacgtgtccagccaagctcttcacctcttcataaagtctttcaaaaaggctatccgattatttacaaaactgtaacaaatattaaatatatattacagaaagcattttttgcggcttttaggcaaaaaaaaacaaaaaataaaacaaaacaaatggccattttctacttttttttctttattcccaaacnnnnnnnnnnnnnnnnnnnnnnnnnnnnnntttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattaacgataccgtggatcgctaaacaaataccaaccaatccatgggtagtaggaggcatcttgggggtaaattcagccattatcgaatcaatcgtggtgaatacgttgtcttttgtaatcaagatatcttgtttttccaaaatggctattcgttgaccattgatataagatagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttcttctgtcattcattttattctccttttatgtgtcctttgtctacgtaaaaaatctctgcttcaacagacattttatcttttacatgttcaagtgtggttgtggtaataaatgtttgtacttttccttcaattgtttctagtaagtgtaactgacgagaatcgtctaattcactcatgacatcatctaacaaaagaatcggatattctcccgtttcttctttcatcaaatcaatctctgccaattttacacttaatgcagtggttcgctgttgaccttgggatccgaatgtttgaacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgattttgtgggcgagctggcattatttgaagaacaacattatggatgctttatagaagcaatatcaccaactaaagtatgtaccattcaaaaggacaactttaagcggattttactatcgcatccccaaatagctctagaacttttatcagaaatggcgagacgtcttgataatacagaacgattaactgtaggaatcacgactgaaagagcagaaacacgcttaattcagtatttgttagaagaaaatataaagcaaaaaacagagcaaaaaaaaatggaaaataacaaaaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaccgatgattacatagtcaacacctaagtcagctaaagcagctggtgaagtttctcctgtaaaggcaccttcattttcccagtagctgttttgagcagcaatttttaattctgtaccttctgcagctgttactaatgtttccaagaacaacgctggtgctccgataacagaatctactttatcgttgctaggaatttttgttttgactgcttcagcaaattcttttgcttctttcgcagttttattcattttccattttccggcattaatttgtttgcgcatttttctgccactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcttaataatttactggatgcttttaaagattttggtaacatgaaacaatacgccttcttcagattattggcatacacaggtatgagaaagagtgaagtactcgctctacagtggaaagacatagacacgtttaataaagaactacatgtcaataaaactcttgctgtggatgaatttggtaaagttataattcaatctccgaaaacaagagcttctagaagggttatctctttagatactgagactctttctatcctcaacaactgaaaataaaaacaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtaggtcaactaggatcaacgttcaaggaatcaagcggtggtgtatcctcttggatcaaagaaacttcaaccaaacgattggcctttttcgctgcttggacttactgggtcgttcacgtcccatatctcgcacaaaaaccacaagggatcctggtatcattgagttggttatttaaaggaaacggctctttcgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcggctaatgaacattcactgactggacaatatctttcaggaaaacgggagattccaacgccggcagaacgtcgagcaggaaatggacagtccattcgcttgactggcgcagctgagaacaacttgaaaaatgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaaaagaagcagcgaaagaagagattcatgtaactttttctccaatggcagactatgtaaaagatccacgctgggggagagtcttggaaagtaacggtgaagatccgcgcctatcaactgcgttaacaaaagcgtatgttcgtggctatcaaggcgagaacttaaaaaatgagtcacacgtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctcagaagcctatcatgaaaaaaaacgtgagaaccttcaaaaagcccttgagatgattcagcactatcagcaggaattacaacacttgcatcaatctcatagagatctgtggtttgaatggaaccgcccctttgggtttgaagtgatcgatcttcgctacggcgctctatctaaacgtgccgagatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcattagcgaacaatgcgacttttaaggcagtagcccaaaaacaaggaaccagtgttaatggcaatagtacctggtatcgggtggaaggcaaaggctgggtcagcgccgcgtatgtgaatgaggcagggagtaacaatagcagcaataaatctgccgaaacaatcagcaagcaattaaagagcacggcacagcggaatagtcgttcaaacactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgctttgaatgaaacaagatgcttgcgagaagttgctgaccccaatggtttttgaatctctgctattgcttcttccgtcagactatctgtaaagaatgggcgtccttgtgcctgcaaatagtccagtgcatcttctttagtgaggttctcagcttcttgttctgtaatgattgcgttctgagcacgaagttcagcttgattcgagtaagaaaccttcacttgatagctgtattcaccatcgggaatctgccaatcgactggatctgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttcttctttgattgttattcttttgtgttcaatgaagaaatatgctgatcaatcatctgctttagcccatttacttcttcataaagtaaattgaactctttggccaactcactcataatatctgcactcattaacaagtcctcggcgtgactcaataacaacgacatccaaactttatcaccttgtgcttcttgctgtaccaattgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatatcatagttctcgccagaagaaatgatcgtactcattttttgatcccaatcgccccagccaatgtactgtaggtcgatccgtgcattgattttttcctcgatccgtttgttggcgatctccatcaattgatcaaagttctctggtttgtccccgacttgatacatcaacaaagtctttacgccatccgcactattagaatcagaatccgacgactccccgtttgacccgcaagcagctaagctcaacagcattgctgaagcgaatcctgcaaacaatgtttttttccacgatttcatttgttttcctcctctctccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaagcagattaaactggataaaatcatcgataaaatacgtgaaaagtacggatttacttctagttttgataacttctcattttttgttaacccatcaccaatatctaaataatgtaaaattccttgttgttttttcgatgtatctttaaccaaaataactattgttactcccgtcatgatatcaaaaatatttcctccttcaatttttgattgttctttagtttttcctctaattgctccttttattttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttttgtttgtttgtctaattcggaaagctgctgcagattgttttccaagttttcttgatagcccccctgatttgcaggatctttcttactcaattgttgggcgatatttcgcgcatagatcatcccattttccaaattaagccatgcatgaggatctgcctttgtatgatcagcatcatccgatagatacaggacttctacgccatcactgacggcaaaataatcttcacccgcttttttgttggcgttgttcattaatttagtaaaccagccgttgccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatgttccatcactattgtgtggccaatgaattattggaggtcgatgcgcctttgatcaccatcaattgcgcacagtacgccaacaaccaagagctattgactagtaatttatttggacatgtcaaaggggcttttaccggcgcagaggaagatcgtgctggtgcttttgaagcagcagatggcggtgtcttgtttctcgatgaagttcatcggttgaatgctgaaggacaggaaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcgtccactgctccaacccgcgatcattcaaatagcacgtaacgatcgcaggtccttgcaactggatttcccccagttttccttctttttcgataacagattctttcaaagactgcgactgaatccgcaaattgacttgggctaatggtaatccagcagaaccaattttttcctcggctttatctggaggcaaagcaacgacttgcgaacaagtttcagtcatcccataggattgaataaatgataagcacttgtcttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccaaagaacatacaaaagacctagtcgctaaaaaaggccgtgcttcttatttaggcgagcgggcaatcggacatatcgatccaggtgccgcttccagtgcattgttgtttgaaacgcttgttgcaacgattggataaagatcctcattccacttaggaaaggcgatacaaaaaaccgagagatctcttgcgattcttgaagataaacaagaatctgtgcttgagacctctcggttagtttatttttctaagaaatagtcaacgccattatttcaaaatagcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgctttttcatcaactaatgtttccatagcagaggcaacaatacttaattcatggaaaacatcgaagtcctgtgcagcaccaatacctttagcatcaccgattgcttttgctaataaggttaaaactgcgatttgagcagtataggccttggtagaagctacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaggatagcagtgtgtattggggcgccgactccagtaactccttttgccgttttgcacgctgttctctagccgccaatacttctgctaatgaaacttccggtccctcaaataacaagctacacatttctcacaacatcaatgagcgtgccgtctcgatattcaatcaatgccactactttatcgccataatgaatggcttcaggcgttccaacaatctggtaagctttctcttttaactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagctttattaactaatttcccaattcttcctggaaaatatcccaacaaatagatagaccaattcagccatgaaaacaaataaatcttttttccatttgcaagcgcaagatctctaaccatataacttgtcctaacgtagttttcatcttgtggaaaaaaaataccactatctgagttatcaactcttagtttaataaattcacataacctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaccaacgacagggatggatgagcaatcacgaaatttattttatgaattactgcgtcacaatgcacacgatcatgggaaatcgattttgatgatcacccacgatcacgaagatattaaggagtatgcggatcgacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcattaggccaaatcggaattttgcttgtaaatattttttcatagacaacggcaatgaacgaacaaacagaaaattttgctgatccaatgaaatcaaggtactgataaaagaggttggattgaccatcatcacagctaatgcgataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagattcggctagcggatcgtaccagtgagttttacaaagcggtcttgacttatcaagacaaccaaaaggggactgtttccgctttaagcaaacgagtggatgattttttaagcgaattgaatcgttggcgggaagcagctcgcagactgccgatccctgatttattatgggatatttatgatacaacggcttacttggattacgtggttggcttgccagcagggcaacagcgctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaggaggaactaaggaatgccgaaattagcattattcaaacaagatggaagccaaaatggcgaaattacattgaacgaagaaatcttcggaattgaaccaaatgaaacagttgtctacgatgcaatcatcatgcaacgtgcttcattaagacaaggaacacacgctgtgaaaaatcgcagtgccgttcgtggcggtggccgtaaaccatggcgccaaaaaggaactggtcgtgctcgtcaaggttcaatccgttcaccacaatgnnnnnnnnnnnnnaagtaataaagtgacagtttttgacacaaaagactttgaacttgtaggaataagtgacaagtttagatggatactatcgccaattgtaatgagatcagcatttatgagactaagtgtgcatttagaaaatgttcgcaagcatcctttagatatccgtcgatattataaggccttagattactagttttttgagtaacatatttcagagaaatattaattagtaataaaaaataccagagtggagcaatagtcaaaagaaaatatgattattgctacaatctcgtattcgttttagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagtgacatgaagggttggcgctcttttgctctcttttgctcctatttactcctaagttattttcgttgaacaaaacaagcagtataatgatttcatagaacaaagcaacagttctccaaggagacggatgcttacagatggagctttatgctatccggattacttaaggcagtatcttgagttgtttatgaaaaaggagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtcgcccatttgggaaaaggatttctcttttgaatgactgacatgtccgttcgaagcttgatagggagcatcaatctcgaatccctagttgctaactaaggtaagtataaagcggtcaactaagtgtaaatagttctgaaatacgccgatagataatcagaaaactacccaaatccgggagaaaattgcttacaaaaagagattgacacttattatatcattcgataatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgacagtgcacgagtcttccctgtctcctagtatccatgccatcttagcagccgagctgggaatggaagaaaaagcactggaaatgtatgaacgaacggctcggctagatttggataactacaacaatgataccgacgatggtttgcatatcacttcaatgactggcagctggttagcgatcgttcaaggatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcagaaaccaagaaagaagaaatgaaggcatttcttctttcttttctttccggctaccaaaataacacaactttatgatactataagctaaaaaaggagggaaaacagtgagcgtaactgtcaaagatgtcgccaaaaaagccggcgttgctacttcaactgtttctcgggtcgtgaatgatcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttcattcctttataactttcatcagcgacgaccgcttgactatctgcaccatcagctgtcttaacggtcatttctgctgattgaatactaagatttgtctcagcttggataccatcccgaccactttggatcgtaaatatacccccatcaatcccaatatagccttttgtagcatcttcggtattgttggcttggataccatctccttcagaagtcgtcagagtataattcccatcnnnnnnnnnnncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcgtaatgactttctctgcctgctcgataacaactgctgaactgttagcattcgtgatacttactccagcaaaaatcaaatgaactttggcttctttgtcgacgttgattttcaactgaccatctgtcaaagaaccgctgaccatatatgtccctgccgaagtaatcgttactgtttgatcatcaactgtaaatccttctccagcttccgtttgtgaacccgccagttttatcgctatggctgaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctttgactgtttttatttattggtctattgtttttatatctctcttctcgacgttcatcagatagaaagtaaacgataagaagtgtcttttaacgcagctgtcaatgcttgctctggggcatcgcttatgacggtcgcagttttcttgttcaaattaactgtaacttcggtaacgccggcaactcgagcaagtgtttctcgtaccgtttttgcacagccttcgcatttcatgccctcgacttgatttgtttttttttttattattcttctttcttctttatttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaccatcaacaagcaattcaagaccacggcagttttgaatatccgttccaatccatcaactagtgctagtgtcgtagggtcattagcgaacaatgcgacttttaaggcagtagcccaaaaacaaggaaccagtgttaatggcaatagtacctggtatcgggtggaaggcaaaggctgggtcagcggcgcgtatgtgaaagaggtcggcagcaacactaacagcaagaaatataacgtaaaaacagaagataaattaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagcgctacaaaaaatcaaatcgaactgttctttatgacaaaacagtttgggcgaaacccttatgtcgcacagaaaattcatgaggcaggtattaaaaaagttgtggtggtggattacaaggaagctttagtgatgatgaaacaaggcttgcctttagggaatgtcggtcatcttgtgcaaatagatcggaagagcacacgtctgaactccagtcactctcgcgcatctcgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgggatcttgataaagaaatgaatgtgacttattgggaagtcaaagttgaagacggcaacaaaaaaacaaatgttaaaatcaatgcgcaaacaggagaaattttagaaattgaacaagatgactagcaaaagcgataagcaataaaaaaagcaaggcagcgaataatgaaacttacgccagtaagcgttctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcggttattgtacaagtctgcctgaaacaagagaatcacgtattttcatgacttatagtaattccgtcaatgaggtagccactttggcgcatgagttaggtcatgctttccatagtagtgttctttgggacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcagtttctactgcaagtttgtggtgtcatggctctgatcggaatcgtgattggttcattaggatcgatcatctcaatgcgccgtttcttaaaagcgtagaacgtgttattgaaacagatctgctgactagcaggtctgtttttcatttgccgacacctttactttagactgcaagttcgctattcttttaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcacttggttttcctactgcttattcgcccttaagttagtcttgattaaagcgttcaaattgttgccgacggatctccaataagcgttgagcaccgatacgatccaattgctgcacatagttggtccaatccttttcaaaattccattcacctgtaatgaactttacccgcgattgttccacatgggttgagatatctgtaacgatcgttgacaattctgctgcttctgcttcggttgccataaatgtcggcagcatgtattccggcatatattcttctttgacattatcatacacatccggttctttgccaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccatgcataaattgagactacaacagcaattaatcccaccattgttgcaataaaacgaccggtaaaatatcgtttcatcatcagaagattcttgatgtccaccataggaccaaagaccagaaaacccacgactggaccggcgccgaacagactaagcagcgaagaaccgataaacgcatctgcttcagagcacagcgacatcgtcaatgccaaaacaagcatgaccaataccgccaagaatttcgtagaacccaaagtcaacatcattcccgttgacaaatacgtctgcatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataatgatgggtattccgaaaatgtcctatcatttgtaaataacgtgcgcacgaaagacggcggtacccatgaagtgggaatgaagatctctatgactaaagctttcaatgaatatgctcgaaaggtcggcctgctgaaagaaaaggataaaaatctggaaggcagtgattttcgggaaggtttagcggcagttctgtcgattcgggtaccagagaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcacgaatcattcactcgcctagtcaagaaggcatgcaaggggcaatcaggaaagccaaatttcttgctgatcaattgccaaactcttttttgccgctacagtttgaaaatgaacaaaatccggctgcctattatcgaacactaggtccggaaatcgttcaagaaattcctgagagaattgacagttttgtagcaggagtggggagtggcggggcgttcgccgggacaggggcggagttaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaggaaagacaatttttattgttcatcatgatttaggcaaagtgactgaatacttcgatgaactagtgatgatgaatcagcatttaatcgcatatggtccgacgacgactgtttttactgaaacaaatttgaaagaaacattcggcgatacgatcatcgtgaaaggaggggcttaagatgattagtcagtttattgatggattagttcattaccattttctgcaaaatgccttgatcaccgccgtagcgatcggggttgttgcgggggggattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaatctttttagacgcggattcaattattgatgcgatggaaattattgaaccacaagatttttatcggcgcagccatcagattatctttcaagcgatgattcaactcaatgatcgtaatgaatccatcgacctaatcacattgaaagcagaaatagaaaaaagtaatagtctggaagatatcggcgggcttacttatttaacaaaacataaccaagcttctccttcggccgccagtatttcttattatgcaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtctattgctgatgtgttaaatcgaacaattgaaaatattgatcagttagcgcaaaataacgaagaaattaccggattgcctactggctatgcagctttagataaaatgacagctggacttcaaaaagaagagctaattattttagcagcacgtcctgctgttggtaaaacagcttttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaaataatcattcagaacatgctttatttttgttggtacaaaaggattttcattcaaaaaaataaactttgagcaaataaaaaaaacaaatcactttcatttaactttacacaataatttaaaaaaacagccttattaaattgaaaaagcttacaatatcggttataatcattttgcatgtatagacaagtagaaaggagagaatactgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattattaggtaatcgtttaaattttgccacaattttacaaattcagcaatcttgcttctgttttattacagaatcttaacacgattgcaacaaaaatgaaacgataaagaatttgttattttaacttttaacggcgtacatccctattcattaacacatctaaaaaaactatcctaaggaaagtaagagacacgctttaacagaccccttcattccttcggatagttttttgtattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttctagcttcagtttccagcaaacgacaaaataatgcgtcaactgttagcttttcagaaataaagggggctcctttgtgccggtgtctctgtcttaattctttcttttagcaagccattcttgtacttgcgtcttaacttcttcaatggttccttgattgtcaaagaggatatctgcccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcaacaacaccaacaacatcaccagcaacagcagagaatgcgcagagcgctccggctgctgctaatcctttccagctctatcaagaagtctttggagtgattaacggattagttgctgatgatctacgtcattgggttgaggatattggcgaagaaatggtttgtgaggctatgagacggtctgctatagaccagaagtcatacggatatgccaaaggaattatgcaaagctgggtaaagaaaaatatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttctgagtccgattggattttttctgctgcttttttgattcgtgcaaattcttctttatcataatttttaggcaagtcgatccagcctaaaaagtcgttacctgcaccagtaccttcacgtaagagtttatctgctgctgtaacttgactttgcatgtagcttaattcgtattcattcacgaatggtgctacttttgaatagtcaaatttgatgtgtgacatgatttgtcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcagatcactgatgaaatatgagaaacaatcccctgatgcgatgggggtcgctatctgtatggcaaaatatcattttgaattaaaactaaaaatcgttaaagaatatcttagtggcgtgggaggatatcggcatcttgccaacaaatacggtatttcaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3 - DNA, 1506 bp, Enterococcus gallinarum; identical to SEQ ID NO: 1
